United States Patent 11,337,426 (BIOLOGICAL CONTROL AGENTS AGAINST FIRE BLIGHT) - sequence listing, part 8

SEQ ID NO: 110 - DNA, 167521 bp, Bacillus velezensis FL50S
ttgtcgtccgtgattccgagcttcagctcccgctcaatggcttcaatcatggcctccgtcaaacggctggtttccccgtctatcagccttgtaagctcttttccttccatttgtgactgggtcatgcgctttgtcccgagcaggtgaatggcgatataggcggtttcctgttcgggaaaggtgaccgaaagcgcagattcaagctcttttacgatggcttccgctgactgatattctgtttcgagcttaatatcatgaagatcttccggaatgagagatacatagttttctgtccggattcgtttgcaggcaatggcgatatggatgatgagattgttcaggccgaagaaagaaagcgggatcttatggtttcgaacctgcttcataatggctgtgcggatcacatgaatgtcgtctttcggcagaataccggccttttcactcaggagatcaggctcgggctcgcggtcgtccactaagtattccgccatacaataacggaggcggagctcttcgccgcgcagcttaaagccgtagttcggccttgtttccaaaatgatgtcataggggcggagccgttttttgacttcttttaaatcagattgaagtgtggatttactgatgaacagttcttccgccaagtcatccagcttgaggtagccgtcggccagaagcattcttttcatcaggtaatctatccgttcatcgggaaaaatcggcacggtactgttctgctggaaattgtcctgaagccagtttttaaacggctgctcattccggatcagcagcttatagccgctccctctgacagattgaatggatgcgccgtgtttttctacaatggtttgcagttcctttatgtcattgcggaccgtccgcgtcgttacctttacatttgcagcgatgactgagcttgtaaccggtgtttcagcagctaaaagcaagcgcagaagttcacgaagccgcccatgaagcatgagaaaaacctcctatcagatcagatgcagatgtgaaaaatgggcaaaaagaatgaggaaggggtaaatgtatgtaaattctatactggggaggatttcaagtcaatgcggcaatccgatgccaagaccgtaaaaaaacagccggatcagccggctgttcgggatgcggacatgcggttccgcttagatgccttccgttcttttatgatttttctgataatcggatagatgacgggcgcccatttgataatcgttttgaaaaattttttcaatgtctgaatcccctttcttttaccttgtctttcccctgttatcagcgtttataaacatggtcagcgtgagacataccggttccccgtcacccaatagcgccacggataatcccgggcttctccgctgttgtcaatcccgattctcgggcctgttgatatatgttcaggcgtaaagccctccgtaatatacagcggcggttccgtgatcatgccgccgtagtcgttcattgaaatgcccatcgccttcgtcagttttcccgggccgtttgtccactctctcgggggtctgcccggtctcctgctctccatcaggaactgtccttcatgaggctccgccgccctgattaacacggcctgcggaatgccgatgtccgcggcgacgacgttcattaatgtatgagtgtgcatgacgtatgtataaatgcggcccgcctcatggaacataatttccgtccgtttcgtgcgccggttgccgaaactgtgcgccgcccggtcatccgctcccatataagcttccgtttccacgatataacctgaagccgttccctcatccgtctccttcacaaggagacagccgagcaataaaggggcaagctccactgacggtctctggtaaaattcaatcggcaaaggctttccttctcccgccatttgcctccctcctttctgaatatagcgatttcctctttcacgtttttcacttcttttttacaatataaacatgaaagaaaaaagggcatcattgttgaacactctattgcgttttgaaaatcggcccggtataatatgatggttcaaatgaaaatgattctcatattcaataaataccggacaatgatcataaaagtaggtgaattgatttttgagcgattctgtcacgtccgcaagccgtctgatcagcatcttaaaaaacggggttttcttcctgatcgcggtgatcgggctgcttgtttctatttttttcgccgtctcattcggcgcgaaagacattactttacatacggtttggtcggctgttgctgattacaatccgaacataacgggccagcagatcattcatgaattgcgtcttccgagagtgctcggcgcggccgttacaggagccgcttttgccgcagccggcgccctcatgcagggtgtcacgagaaatccgcttgccgattcgggtgtcttaggcgtaaacgcgggcgccatgtttgttgttgcgctcagctttgcttttttccctcatttgtcatacgccctgctgatgatggtgtcatttttgggagcactggcaagcaccggcttgattttctttatcagtgcggcgggaaaaggcagcatgacacctttaaaggtgacgcttgccggggcggtcgtggccgcgcttttacattcactcagtaccggtgtagcgatttattacgatttaagccaggatttggccttctggtacgccggcggggtgtcggggatcaagtgggctcatttacaagtccttgttcccgtgattgcggtcttcatcattctcgcgacattcatgggccggtccgtcacccttctctcaatgggaaatgacgtggcggcgaatttaggggtgaacacggctctgacgcgtgccgcgggattaatgatcgccgtcgttcttgccggtgtgtctgtttccgctgccggcgcgatcggctttgtcgggctggtcattcctcatatcgcccgcaagatcgtcggcgttacgtacaggctgattattccgatgtccgcgttgctcggcgcgattcttttgattttggccgacttggcctcacgcacggtcagtcccccgagagaattggcgataggcatcatggtggcacttgtcggtgtccctttctttctttatattgcccgcaaggaagggagagacttataaatgaaagtgcagaaagaaacaaaaaaagcggcggcggcaggtctcgttctgctggtcatcgccgtttgcattattctgatcgggctgcacacgggctcattccggctttctcccctcaccgtgggaaaaacgctgttcggttacggcacgtttcaaagcacaaccgttttattcgattaccggctcccccggatactggtgacgatgctggccggtatcggcttaggcgtgtcgggtgctattttgcagggtgtatcccgaaatccgcttgccgatccgggcattctcggactgcatgccggcgcttccttcggtttgatgatgtatatcacattctttcattccctggaggcgcaggcgtcgatgttcatcccgctgtttacgtttgcgggcggaacactcgccgccctgctgatcgtagtgcttacgtacgacaggctgaacggttttttaacgatccgcatgctgttggtcgggatcgccgtttccgcgggcttcagcgccgttacattgtttatgtcgctgcgtctgaatgaagaaacttataccttcgcttcccgctggctggtgggaaacgtctggggcagggattggattcacgtgtggtcgctattgccctggatcggcattctcgcaccgcttgcatggcttaacgcccggtctttgaatattttaatgctcggtgaccaggcagccgcggggctcggcgcacacgtgcagagaaaaaggatcatgctgatcgccatagcggtcggcttgtcctgcgcgagcgtcgcgatggccggcggaatcggctttatcggctttgccgcccctcacttggcaagacggctcgtcggcaccatgcatcagcatattattccgattgctggattaatcggccttgtcattcttgtcgcggcagacaccatcggccgatctttgtttcagccgaacgccattccggccggcgtggttgcggcagccatcggcgcgccgtattttctctatctcgtcatgaaaatcaaatcataaaacaaggagtattcccatgaaaaaaataattgcgctcatcagtttcatgtgtattttcttactggctgcctgccaatccgattcatcacagccggagtcaaaaaagaaatccggcgatcataaaatcgcttcgatgtccattcacctgacaaatgatctgctggctctcggcgttacacctgccggttccgtcgtgggcggagaattaaaagattttctccctcatgtgaaaaatcagctgaaagacacgaaaaaactcggacctgcctcagacccggatatggaagctttacttgagctgaatccagacaacatttatcttgataaagaatttgcgggaaaagatgtgtcaaaatacaagaaaatcggaaacacacacgttttcgaccttgataaaggcacatggcgcgatcatttaaaagacatcggaaaaatcgtcaaccgtgaaaaagaagcgaaaacatttattcaagattacgaagatgaaacaaaacaagtcagatccatgatgaataaggaattagggaaaaacgccaaagtcatggcgatccgcgtgaacgcaaaagagcttcgcgtcttcagcacacgccgcccgatgggaccgattctgtttgacgatctgaagctgaaaccggctgacggcattaaagaaatgaacacctcccgcccttatgaagtcatttctcaagaagtgctgcctgattacaacgcagatgcgattttcgtggtcgttaacagagacgacaagtcacagcaagcctataaagaattgcaaaaaagcgctgtctggaaagggcttaaggccgtgaaagcaaaccatgtctataaaattgccgatcagccttggcttgattattcggcactgggaaataaattagcaatggatgaagcgaaaaaactgttccaaaaataaacatgagccggttttgcaaaaagtgcaagaccggctttttttatattgccgtttacttatataaacttctgcttatataatagtgtaaaaaaggagtgagcgcatggaacggcggcataatgctttaagttccgaagggatcagccagtgcctcaaacttctaagcgacccgacgaggcttttgatgctgaagcttctggaggataaggaatattgtgtctgcgagctgacggctatttttcatataagtcagcccggcatcagccagcacttgcggaaattaaagaacgccggccttgtgcgcgaaagacgcgagggccagcggcggtactatgccattcatccgtccggaccggaatacgcgctggtctgctcgattctccagcagatagatgaaaaggacgaagttttacagacattgcggcaaaaagaagtcactgttacatgccggtaagggggatatattcttgggagttgcggttttatcagcgctgatttttgtgctgacacttgtgtttgtcatatggcagccgaaacatatatcaatcggctggtctgcctgcggcggagcggtcctcgctttgatcgccggagcagtcagcctgcacgatatcgcggaagtgacggggatcgtctggaatgcgacactcgcctttatcgccattattatcatttcattaattcttgacagtatcggtttttttgagtgggccgcgctgcatatggccatggcggccaaaggcagcgggctgcggatgtttctctatgtgtcggtcttaggggctgttgtctccgccctgtttgccaatgacggagcggcgctcattttgacgccgatcgtactggcgatggtgcgggctttgaatttacctgaaaagctggtttttccgtttattatcgccgggggattcatcgccgacaccacctcgcttccgctcgttgtaagcaatttggtcaatattgtatccgctgattactttcatatcgggtacattgaatatgcatcacgcatgctggtgcccaaccttttttctctggcggcaagcattttggtgctgtatctctatttcagaaaaaacattccgaaacggtatgacaccggtcttgtgaaacatccggcatccgcgattaaggatgagcgccttttccggttatcatgggctgtgctggccgttttattgatcggatatttcgtcagcgaactgctgtcgatacccgtttccttcgttgccggctccatcgcggtcatttttctcattctggcgcagcgaagccccgccgtccctgcgaaacaagtcatcaaggacgccccgtgggccatcgtgtttttttctgtcggcatgtatgttgtcgtgtacggcttgcggaatgccggactgacggatcttctttctcagcttattcagaaagcggcggatcacggattgtttgcgggcacactcggaatgggttttatcgctgcgatcctctcctccgttatgaataacctgccgacggtgatgattgacgccatagccatcagcggaacggacactcacgggctgctgagagaagcattgatttacgcgaatgttatcggttctgacctcgggccgaaaatcacgccgatcgggtcgctggcgacattgttatggctccacgtgctgagccggaaaaacgtgaaaatttcctggggaatgtatttcaaaacaggtctgatattaaccattccgacgttattcatcaccctgatcggactttatttatggctgttatggctcgcttgagatgaaaaaccttttaagttgaatcttaaaaggtttttttgtgtcaaaaatccgaaaagtaaaacttttatattttaaaagtatagacatttaatttcaaaagattataatattcatgaaaacgttttaactttatgaaagaagggattcctcatgaaaagaattttattagcctgcagctcaggcatgtccaccagccttcttgtgacgaaaatgcagaattacgccagctccatcggtgaggaggccgagatttgggcagtcggacaggataaagcaaaagaagcgatgaaagacgcagacgtcgtactgatcggcccgcagatgagttttttaaaaggcgagcttcagaaagaggcggacccgcttcacatcaccgttgatgtgattgatatgatggcatacggcatgggagacggcaaaaaagcatacgaacaggccgtttccttgatagagaacaaataaaggaggcgataagcatggaaacgtacacggatgaacagatcagttttcagctgattcttcacagcggcaatgcccgcagctgtattattcaatcgatacgcgcttataaagacggccgtccagatgagtcagacacctttctgacaaaggctgaagaagaactgggaaaagcgcacgacatccattttcagatgattcaaaaagaagccggcggcgccaagacggatgtctccctgctttttatgcatgctgaagaccatttaatgtcagcgctctcaatgaaagagatcgtcaaagaaatgctcgacttatttcaatcaaagaatttataaaaagccgggggtgaagacgtgtttgagaaaatcagccaattccttgttccgatcgcgggcaaattaaacaataaccgctacctgcaagtcttacgggatgcttttatgctggcgtttccgctgaccattttcggttcggtgttcgtcgtgctgacgaacctgccgtttttaaacaaaatcatgagcagctccgccctgtctgtctttcaatccggatttggcggcgcttcgacggcgacgatggggattatgtccatttttgtcgtcttcgggatcggctattacctttcaaaaagctacgaagtggaggccgtattcggcggagcgatcgcattggtttcttttctgctgctcaccccgttcgtcttagagccggaaacgggcaaagcggtcgcaggcgtcattccggttgaccggcttggagcaaaagggatgtttctaggcatgataaccgcttttttgtcgggtgaaatctacagaagaatcgtccagagaaacttaacgattaagatgcctgccggtgttcctccggctgttgctaaatcgttcgccgcattgattccggcttttatcacgcttaccgtcttcctcttgatcaatgcggctgtcacccagatctttcacaccaatctgcatgatgtcatttatcatacggttcaagccccgcttgtcggacttggaagcggcatcattcctacattaatcgctgttttctttattcagattttatggtttttcggacttcacggacagatcattatcaattccgtgatggacccgatctggaatacattacaggtcgaaaatttggctgcgtatacagcgggaaaagagattccccatattatttctaagccgtttatggagatttacaccgtcggaatgggcggaaccggaatgacattggccatagtgatcgccatcttgctttttatgaaaagcaaacagatgaaacagatatccaaactcggtctcgcgccgggcattttcaacgtcaatgagccggttattttcggtttgccgatcgtgatgaacccgatcattatcattccgtgggtgatcgcaccgatggttgtcacgctcgtcacctacctggccatgtcggcgggaatcgtgccccctcctaccggcgtgaccgtgccctggaccgtcccccttttcattaacgggattatggcgaccaattccgtcatgggcggcattatgcagctggtcaacctctgtattgtgtttattatctggttcccgtttcttaaagcgctggacaaattaaacatggcaaaggaaaaagaacccgagaccgagcagcatgcacgggatgacagcatgagtatgtaatcaaaatcgcagtaagggagagaaatcaattgactgaatctaatattcaatatcgttttccggaaggattctggtgggggtcttccgcctccgccacccaaacagaaggcgccgccgacagagacggaaaaagccaaaacatatgggattactggtatgaaaaagagccgagccgtttttttaacggagtcggccccggcgacacgtcacgtttttatgatcaatacaaggaggatatccggctgatgaaagaaatcggccacaactccttccggctgtctatttcctggtcaagattgattccggacggaactggagaggtcaatcagaaagcggtcgcgttttatcaggacgtcatcgatgaaatgcttgcccatcgcattgagccgtttgtcaatttgtttcactttgatatgcctctcgcccttcagcgtaaggggggctgggtcagccgggacaccgttgacgcgtttgaacattacgccaaaacatgcttttcgctattcggtgacaaagtgaaaaaatggttcactcacaacgagccgattgtgccgattgaaggcggctacttatacgactttcactatccgaatcacgttaattttcaagaagcggtgcaggccggcttccataccctgctgtcgaatgcaagggctgtcaaagcctacagagaattgaaacaggacggacaaatcggaatcattctgaatctgacgccttcttatccgagaagctcacatcctgaagatctgaaagcatcccggattgccgacgcctttttcaaccgctcatttttagatcccgccgtaaagggcgaatttcctgaggagcttgtcgagattctcaaggcggaaggctttctgccgcgttacgagaaagaagatctccgcctcattcaggagcatacggttgacctcttaggcgtgaactactaccagccgagacgcgtcaaggcaaaagaacatgttccgaatccgcacgcccctttcctgcctgagcgtttcttcgatccgtatgttatgcccggacggaaaatgaaccctcaccgcgggtgggaaatatacgaaaaaggaatctatgacattctcaccaatctcagagaacattacggaaatatcgaatgttttatttccgagaacggcatgggagttgaaggcgaggaacgcttccgcgatgaaaacggcatcattcaggatgattacaggattgaatttatccgggaacatctcaaatgggtgcatcgggccatcggagaaggttcaaatgtaaaagggtatcatctgtggacttttatggacaactggtcttggacaaatgcttataaaaaccgctacggctttgtatctgtcaatctggaaaacgggggcgaacggaccgtcaaaaaaagcggccgctggttcaaatccgtttccgatcaaaacggattttaacagatgaggaggtacggccatgcttggaggtattgaagccggcggcacgaaatttgtctgtgccgccggacaaaaagacggcaccattctggacagggcggagtttccgacgggagaaccggatgacacactcagacaagtcatccgttactttaaagatttcccgatagaagccatcggcatcgggtcgttcggaccgattgacatccgccccgacagtcaaacatacgggtgcatcaccgcgacgccgaagacagcctggcggaactgccctattcttcaaacgatcaaaagcgctctgcgtattcccgcaggcttcaccaccgacgttaatgcggcggcgctcggagaagcttctttcggcgcggccaaaaacgcggacagctgcctctatttgacggtcggcactggcatcggagcgggcgccatcatgaacggcagatttgttcaagggctgtctcatcctgaaatgggccacatttatgtcagaagacacccggacgacggctacaaaggcaattgcccttaccatacagattgcctggaaggcctcgcggcaggtcccgccattgagaaacgctgggggaaaaaagcatatctgctggcggatcagcaggaagtgtgggagcttgaaggctattatattgccgaagcgcttgtgcagtatattctcatactttcgccggaaaagatcattctcggcgggggcgtcatgaagcagcatcagctgttctcttatatccgtcagcacgtgaaaaagcggctgaatcaatatattgacctgcccgacattgaacacttcatcgttccccctcaattagggattcactccggcgcggccggttcgctcgtattggcggagcgcgcattagagacggcaaaccgggaggcgggaaaatgacgaaactcttatttttggaaccggtttttaaagaaagattatggggcgggacgaagctgcgcgatacattcgggtatgagattccttctgagcggacgggagagtgctgggcgatttcagctcatccgcacggtacatccatcgtgcggaacgggcctttttccggaacatcattacaccggctctggaatgaacaccctgacctgttcggacatccgaaagaagacgcttttcccctgctcacaaaaattcttgacgcaaatatggacttatccgtgcaggttcatccggatgacgcatatgcacatcggcatgaaaacggagaactcggaaaaacggaatgctggtacgtgttggactgcaaaaaagacgcggagctcattttagggcaccgcgcccaaacaaaagaagatttcgttcggctcattgaacgaaacgagtgggatcacctgctccgccgcatccccattaagcccggcgactttttctatgtcccgagcggcacactgcacgctttatgtgaaggtacgctcgtccttgaaatccagcaaagctctgatgccacctaccggctttacgactatgaccggacggatgggaacgggaataaacgcgagcttcatcttgagaaagcaattgacgtaacagacattccccataccgatgaaaatgtaaaaagcactaagcatcggatcggagatgctcttattacgatactcgccgaaacacctttcttttcagtttatcaatgggatgtgagcgggaaagcatcattccccgcacccggccggtatttactcgcaagcgtcattaaagggcgcggagaactggatggatgccccgttcacaaaggcgatcactttatcgtgccggcggattccggagattttgttatagaaggagattgtgaggttatcgtttcacatccttcatcatcttaaaaatcaggaggtcttttatatgcttaaaaagttagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagcgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaagctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccgcgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggaaaataacaaaaacagcgaagaaacgctttccagtaagacgaccggtaaaggcgagtcagaagacacgctgacaaaccggcagggccatccggtcactgacaaccagaatgtcaggacagtcggcaatagaggaccgacgacattggagaattatgattttttggagaaaatcagccactttgaccgcgaacggattcccgagcgcgtcgttcacgcgcgcggcgccggcgcacacggatactttgaggcgtacggaagttttggagacgaggagatttctaaatatacaagagcgaaagtgtttcaaaagaaaggaacgaaaactccggcgtttgtgcggttttctaccgtcaaccacgggaagcattccccggaaacattgcgtgatccccggggttttgccgttaagctttataccgaagacggcaactgggatctggtcggcaacaacctgaaaatcttttttatccgtgatccgctgaagttcccggatcttgtgcacgcatttcagcctgatcccgttacgaacattcaggacggcgagcgtattttcgacttcatttcccaatcaccggaagcgactcatatgatcactttcttgttttcgccgtggggcatcccggccaactaccggcagatgcagggctcaggcgtccatgcctacaaatgggtcaatgaagaaggaaaagccgtgctcgtcaaatatcactttgaaccgaaacagggcatacgcaacctgacacagaaggaagcggaagagattcaggggaaaaactttaaccatgcgacacaggatttgtatgaggcgattgaaaaaggcgattaccctgaatgggaagtgtatgcgcaaatcatgactgatgacgagcatcccgagctggattttgatccgcttgatccgaccaagctgtggtataaagacgatttcccttggaagccgatcggtaaattggttctgaacaaaaacccggaaaactaccatgccgaggtggaacaagcatcattcggaacgggcgtgcttgtggacggccttgatttttcagatgacaaattacttcagggacggacattcgcctattcagatacccagcggtaccgcgtcggcgcaaattacctgcagcttccgatcaactcgccgaaaaagcatgtcgccaccaaccaggaaggcgggcaaatgcagtatcgggtcgatcgggcagaaggacaaaacccgcacgtcaactatgagccgtccattatgggaggactcaccgaagcaaagcaggatgggaaagaccatacacctcatgtcgaaggcgatgtgaagcgggaagcgatcgaccggccgaataacttcggccaggccggtgaaacataccgcagattttcggaatttgaacggaccgaattgatcacaaacctggtcaatacgctttcttcctgccggaaagacattcaggatcaaatgattgagaatttcacaaaagcagatccggactacggaaaacgtgttgcggaagggctgaaaaaagcctccgaaagcaacagcggcgggccgatcggcactactgatacagcacaagccgcaaaacaggctgaacaggaaagccatccgtctgatccgtattaaataaaaaaacaggacaatcgcgtcctgtttttttttgagctaattcagctcctgtatattctgctccgccgcggccgcaaatactttcggctccggacggtcaagatcttcatggaataaacttactttgtgaatctgccggttgtcgtacagatgaaagtagtagttcccggtgtcacagcacataaccgacgtatactgcgtataatcaatttcattctcctctgtgatcaccgcgccttttggaatattcacattggacagcacgtgaaaagcggccgtaacgccatccgtttcatgagcggcaggctctaaatgctctttcagataagcggctctgatgaaccgggatggcggcgtgtaatcaccgggaagcccgatcgttccagatccttggccgaaagcggttaatgtcattccgcccaatgttttgctttctgactgctgcggcctgattccgatataatggcgcagattggtcacatgccaaggaaattccggactgttggtcatcactccgggtttgttgtcatatactttcattccctccggtgtcggctcgatgacaatgcagccgcccgtgcggtctgataaaatccaatgaagaggcagcaccgtatccaataacattaacttcttctctacaatcgtcagcattgagagcttttcctttatgtcttcaagagattcacagtttgataaggcccaggtgacaaactcatgaggagcgatgtgacaggtgccctcccgttccgctttctcgtatcccgcaaagcccggaaaatacagcgtcgcacacgacagccctttttcatttacgccgtcggcaaacagaacattgccgagatttctccccatgccgataaatgcgtatttcgtcttatgcatcctgccgtcagcttcgcttttccagctgtactgacgagggtaaagcacgacgtccgtaccgagctgaaatgcaaaatccatcgttcgcgccaataggtgattaccgtctgtcgttttcaatgtaagacttgtacacatatcatcaatccccttttcattaatgaaatttacacaaagtaaactattctttcagcttaacgaataatggttccattcgtcaaaagattgacacatttctccttcatacatattagtccgtaagcatatccatgccttttaatccctggcaaatcgtttaggcggcagtgtttgtaccgtttttcaaaaaaactttgaacggctgtcagcgaggctttacaatgtttttcctgcatgctggaatttgtaaacggcaggtcaatctgttaagctatgtctttatgttaaagaagaacatacggaggagattatctattgaaagtagaaaggcgaacgattgaacatattccgcatgacgaaagacacggaaaggctaaagatttattccccgtctggttcggggctaatatgcatattacgacgttagtcacaggcacactgcctgttacaatgggactcgatctcttttggagtatcgccgccattataatcggaacctttatcggcgcaatctttatggcgtctcattccgcacaaggacctcagctcggaattccgcaaatgattcaaagccgcgcgcaattcggcgtgatcggagcgattctgcccctctttttggtcatgtttatctacctgggcttctttgcgagcagtacgattctcgcagccggtacactgagcagctttgtcccgattccggcttcatggtgtattatcggcttaagcgccatctgttttttactcacgatctacggtcatgatctgattcacaaaatgcagaaaatcctctcttggacctcctttgccgttttttttgctgcaacgattcttatttttcaactgccgattccttcaggaagctgggtgcccggctcattagatctgcctgtttttctagtggcggtcagcgcggtggccacatggcagctggcatacgcgccatatgtcgcagattattcccgttatctgccggtcaaaacaccggcatcgcatactttttggtacagctatgcaggtacgtcagtcagttccatctggatgatgcttctcggcgccattttgacgacggcgctcccggaatttaccgctaatgcgggtaatgagattgtccgattgttcggtccgttttcctttattatgctgatcatcgtcctgttcgggcaaatggcgatcaacgtctttaatttatacggagcctttatgtcaaccacgactaccttggagccgtttttaaaactgaaggtgacgccgaaaacgagagtggtaatgatcctttgtgtgacggcagcgggtactgtattaagtctcttgggccaaagcaatttcatggaactgtttttaaatttcatctttttcatcagttatttcttaattccatggacggcgatcaacctcgtggattactattttatccgccgcggaaaataccacgtcaaatcgatgtttgacgtcaacgggcaatacggcagggtcaattggattacagcggccgccttcgttttgtcgattatattagaaatcccgttcatcaatacatccttttacatcgggccgctcgctgaaatattcggcggaggcgacattgcctgggtcatcggcctggccgttccgtcgctgctgtattatgtcctgatgaaatcaaggttaaaacaaaaagaggcgccttccctatgaagacgccttttctttattcatattccttccatacacgcggcagcagttcagaaagttcgtgcgccaataaggtatgggcggagcgctctttcgtccataattccgcacattcgccgtgaaggcggacggcgttcaatacggcgtgcttcggatcttgatgacagcacagcatgccgagaatcattcccgtcagcgtgtcgccggtcccgccttttgcaagcgcgccgtttccggttgtattcctgcggcattccccgtcgggaaaagcgataatggtttcgtttcctttcaggacaatcgtgacatgaagccgctccgcccattccgcggcatattccgctctgttctgctgaatctcttgaatcggaaggcctgtcattctggaaaattcgccgggatgaggcgtcaagatcacgggagctttcctcttcggataggttctttttgtaatggcgcccgcatccagtatgacgggataatcgccagaaagcagctgatcagccgcctgctgcacttcgtctgtttggggaaggcccggcccgatggcagcggcccggatggtttccccgggctggcccgccgcggcttttttccacccgtcccgccagtacgtggcttccggcagcaccgggacgataagcggaatgacgcctgccgatgtaccgatgacgagcttgccgacaccgcttctcatcgcacccaatccggccagaagggcggctcccggcatgtcatcgctcccggccagcaataacgccgtcccgaacgtgcctttatggctgtccgcctcccgtttcggcagcgtatctttcacatcctgttccgtccaatccattatattcatctctgtacctcctcttctgtctcctatttatattccaaacaagaagagattttaaaccgcacaaaaaaacagccgctcgtttgcggctgtttatgttctgatcggaacatcaagacggtaaagcttccgataccgttcgttttctgcaagcagctcttgatgggttccttccatttctgcttttccgttttctaaaaagacgattttatcagctgtttccacacccgctaaatggtgtgtaatccagaggatcgttttctctttaaagacatcaaaaatcgtatcaagcaattctcgttcagtgaccgcatcaaggccgaccgtcggttcatcaaggataatgaccggcgtgtcttggagcagaatacgggcaagcgcgatccgctgccgttccccgcctgagaaacgaatccccgtctcctgcacggacgtttcatatccgtcaggcagtgattcaatataatcatgcagcttcacttgccgagccgcacgcttaacatcttcatcactcgccttgccgtttccgagccggatattgttcataatgctcgtgttaaagagatgaggtttctgattcaaaacggccaccgctgaggaaatctgctcctgcacggccgcagtttccagcccgttcagcatcaccttgcccgaatcgggaactaaggcgccttcaattaaagcgagagaggtcgacttaccggagccgctcctgccgagcagcgccattttttccccctggcggagagtgaaggaaaaacggtcaagcacatgactgtgctgatcataagaaaacgtcacgttatcaaatgtaagtgtcacatcggatacatccagtatctcatctgtctgcttcacctcacgacttcgcagctccggagccgccttactcattcttttgatggaatcctgataagaaggcacttccgtcagcgcatccgaaaggggcagaaacgcctccgtcaatggaaatacgacaagcacaaaggctgcgatcatcgtgttggcgatgctgccgtccgcatactgacccgccgtccagaacagcatgatcaatatgaagccgccgacaaggcattgcgcggcgagatcacgccatctcgtaaaccgctgacgtttgctttcaaggtcaaaccatgccttctctttctcttcataagaggaaataaaggccgcctgtcgtcccgagaacatccagtcgctcacgccgagcacggcatctgtcagccggctgtagagcgtattccggccgcttttcagcctcatgtttttcgctctcgtcacaagaagcgacacaaccggaaacaatacaaccaatataaacaggtaaatcgccgcaaaagcggcaaacggccaggaaaaaaagccgagtccgataacggatgccgcatacagcagcaaagcggaaaccgccgggaaaatcgtttttaaaaacgcatcctgcaaatgctcaatatcctcagccaaaatgccgagcatgtcgcccgtccgaaaacgggatgaaagcatgagcgaggccggctccagcatattgtaaagccgcaccctcatatcggacacgattttcaaaatgatatggtgtcccgtcaggcgctcggcgtaccgtgagactgaacgggcaatcccgaaggtgcgcacggccacaatcggaacgtacaccagcaggatattctcaggccttgtcgccgacttagagatcaaaaaaccggaagtgaacatgagaaaggccgccgaaaaaatcgtcaccgcgcctaaaaaaatcacaagaacaaacaaacgggcattttgctttatatacggcagaatccattcttcttttctcatgttctttcccccagttgcgcctttacaagtttggcatatacgccttgtttcgccatcaattcgtcgtgggtgccgatttccgccgccgcgccgtcatcaagcacgataatttcgtccatctcaagcatccagtgaagacggtgagtggccagaaagacaagtttgttttcaaacaggtctttcatcgtttcttttatttcatattctgtttcaatatcaaggtgagcggtcggctcatccaaaaggagaatcggccggtttcctaaaaaggctctggccagcgcgacacgctgagcctgccctccgctgagcgcccgtccgccctcgccgatccggccgtcaaggccgccgggcagatcgcggatcagtccggaaagacccgctgaatcagcagcgcgcgccgtttcctcacgggaagcatcaggatgataaaaccggatattattcataagcgtgtcatcaaaaatgtacggatgctgcggaatataaagcagctgcttctgccagccgtctgactgcagatgcgagcgggattcaccgtttaccttgatctcaccggaagcaggctctaaaaagccgcccagcacatcaatgagtgtcgattttcccgcaccgctttccccgataattccgattttcttcttccctttaaaggacagatgaaattcagacatcgattctcggacggacaaacgcgtaagctgtaattcatccccgtcagtccacgtatcaagttcgagcggcttttcttctttaaaaccgggctgcgccaaaatcgcttgaatggttttccccgcctcctgcccgtttaacgtcgcgtggtaatcatttcccacttcgcggaccgggagaaaatattcaggcgcgagaatcagcgctgtcaatgccggaccgagcagaatttgtccgtctatcagccgcaagccgagaaacaccgccactgtcgccaccgacagcatcgtaaagaaatccagggcgaatgatgataaaaacgcgacccggagcgtgctcatcgtcgccttgcggtatctctcactgacatgaaagatgtttttactgtgtgatttgcttaaccctaaaaaccgcaatgtctccagtccgcggagcgaatccacgaaatgattggaaagcgtctgataggacttccattggcgatcggcttttttctgtgcgacaagtccgagcaggatcataaatacaatcaaaatcggaagcgcaagaatcagaatcaaagccgatgttttatcctgaaaaaacacgtaaataacaacggccgccggcacaatcgccatgctgaccattttcggcagaaacagctctaaataacggcggaactggctgatgccttccatcgccagcgtcaccatccggcccgtcccctcttttttcgcaaagcgggggccgagacggaacaattgctcaagaaatctttttcttaagtctgcgccggtttgcgcggcatattggtacacgattttctgccggaccgcggttaccgcatgccggaccaaaaacgcaagcaggaaaaagccgataaccggataaagagaagcaatccgcttcccgttaaataatccggttaccgcctggctcagccattccgcctgcaagatgatggcggccgtttgtataatcgttaatcccgtaatgatcgcaagaatccgcttcattcctttataaagaaacaggtcttttcccattaataagtcataggctccttatggctgacgcgtttccggaagacataatagctccagatctgactgccgatgacaaacggcagcagagtcagtgcggcaattgtcatgaccttaagtgaataatcaccggaagacgcgttagctactgttaagtcatacgcgcttttcagcgagctgaccatgacgcgagggaacagagagataaaaatcatcgcaactgtcaaagcaagacccgcgccggtcataccgaatgcccagccgtcttttttcttgctcatgaacacaacagcaagaacgttgcagatgacaatcagcacgaataccggaatcgtgatgtttgcccggcgtgtaaacatatccgtatcgtatgcagacatcgcaaagaaagcaagtacaacaagaaagataacaccgattacgcgttttgccatttttctcgcacgctcttgtaaatcaccgatcgtgcgcagtgtgacaaacattaaaccgtgcaggaatgaaagaagggtgacggctgctccgccaaggacggaatacacgttcacaatatctgagaaacccgcatgcatattcatatggccgtcaatcggcatgccgcggaacaagcttgtgaagataaggccgaatacaaacggcgggataaggctgccgaagaaaatcacccagtcccatgttttgacccattttaaatgattcacttttccgcggaattcaaacgccaccccgcggcccattaaagcaagaaggatgatgataaacggaatataatatccgctcagcatcgtcgcataccagttcgggaatgccgcgaagatcgcgcccgtacctgtcagcagccatacctcattcgcatcccagaacgggccgatggtgttaatcagcactctgcgttctaattcattatggccaagaaatcgggtcgaaatgccgacaccgaaatcaaaaccttctaaaaagaaaaatccgacaaacaaaactgaaacgagtacaaaccaaagatcatgaagtgaccccatggtagacctcctgactgaacggatccgttgatacaggaacatccttgtgatcatcatggtccgcaccttttttaatttcacgaacgaataggaagacaagcagcgcgcctaaaatcaagtacatgacgccgaaaccgataattgaaaacagcagagatcccgtcgttacgttaggcgaaacagattgtgcggttgtcatttgccccataaccgtccacggctggcggccgatttcagtcataatccatccggcagagttcgcaatgaacgggaatgcgatcagtgcgatcatgccccgtaaataccacttgctcgtatgaagctttttgcggcggttcagaataaagcctgcaatcgcggcaaaaatcataagcgcacccgctcccgccataatgcggaaactccagaacgtcgttttaacaggcgggatataatcgccttttccgtacgttttttcatattctttctgaagtgttttcatccctttcacactgccgctgaacttctggtaagccaagtagctgagtgcgtaaggaattgaaatttctgatgtgtttttttctttattcgtatcaatattcgcaaaagccgtccacgcggcaggatcaccgctgtcatcccaaagcgcttcactggcggccattttcatcggctgcgattccattaaatgctcagcctgcatgtgtccgctgaacgcaacgccgataccggcgatcagaccgacaatcatcgaaagcttgaaagatttatggaagaaaggcacttcttttttcttcaataatttaaatgcgctgacaccggcgataaagaaagcacccgtcgcaagcgctccgaaaatgacgtgagggaattcaacccaaagctgagggtttgtcaaaagcgctccgaagtcattcatttccgcgcggccgtttttaatcgtaaagccgaccggctcctgcatgaatgagtttgccgtcaaaatccagaaagatgacataatcgttccgaaggatacaagccaaatgcaaagcaaatgcacttttttagataaacggtcccagccgaaaatccataatccgataaaaatagactccataaaaaacgccaaaagcgcttcaatcgcaagcggagccccaaatacgtccccgacaaaacgggaataatcagaccagttcaatccgaactggaattcctgaagaatccctgtgacgacgccgacagcaaagttaattaaaaagagatgcccccaaaatttagccattttgagataggtctcttgttttttgacaacgtaaagcgtctccatcaaagcaaccataaacacaagcccgatagacataggcacaaacaagaagtgaaacaatgttgtagatgcaaattgaatgcgggctaataccaactcactcatgatgtttttcctccaatctggtaaattgctcaacatttcacaaacatagtgaaatcattgctcggtatttcacaaaaaatgatatatttgctcaatgtttcacaaattcgtcaaaactattgaaatatcagcctgtacaccctgggggacagcggctgtcatagaaatgattcaatatcattactttacaacgattcagcctaaaaaaaaagatcaatatacctaaaataaggctgaaattgtgactgattattgtcggatttgtagagattttatgtcagcacctaggatatttgtccctttgatatcgtacctcttttttattcgtgtggcgaacaaaatgcttttctcggtgaaaaagcccgccaaatcaccattttgagaaagaaaatgtgaagaaagcatgtcctctagtaaattcataatatatgaacaatttaaattttttagtatactttaaatggggatattttttcactacataacgactgggggaacaagcatgggagaacttcaaccaaaattgcaaacggattcaatccaaaaacaggaacggactgataactggtttgccagaacaatgaatataagaatcggcattattcctcttcctatctatatcctgcttttcttgcttattacggtgtttgtcatgagccgtgatgtaaaaagcgacattctgacatcaattgccgtcatgagttttttcggatttaccttcggccagatcggaaaatccattccgatcgtgcggtccatcggcggccctgcgattctcgcaacctttattccatccgctgtcgtctactaccacctgcttccgaaagacattattacttcaacaacagaattcacggaaagctccaactttctctatctatttattgccggtatcgtcgtcggcagtattctcgggatgaaaagagagacgctcgtcaaagctttcgttaagatttttattccgctgatcgccgggtctatcgcggccgccatcgtcggcttatgcgtcgggacgctgctcgggctcggctttcagcacacgctgctttatatcgtcgttccgattatggcggggggtgtcggtgaaggcgcgattcctttatccatcggctactccgatattatgccgatgtcccagggagacgcctttgcgcttgtgctgccgtccatcatgctcggcagcctgtgcgccattatgttatcgggtttgctgaatgtcatcgggaaacgcaaaccggaatggacgggcaacgggaaggttgataagtctgatcattccgctcccgcattggaacagccggccgatgataaaacgtttgatttgtcctttttcgcttcgggcggtattttagcggtttccctttatttggtcggcatgctggcgcatgatttctttcagcttccggctccagtcgtgatgctcgtccttgccgttctcattaagctgttcaggctggcgccggcttcgattgaaaacggagccttcggcgtctcgcgctttttctcgacagccgtgacctatccgctcttatttgcgatcggcgtttcaatgacaccgtgggacaaactgattgcggcgtttacgatcagcaacatcattaccattttatcaatcgtcatcacgatgatggccgtcggttttctgaccggaaaatggctgaatctgtacccgattgagacggcggtcattaatgcctgccattccggccagggcggcaccggcgacgtcgcgatcttgagcgccgctgaacggcttgagcttatgccgttcgcccaagtgtcgaccagaatcggcggagcgattaccgtgagcgtcacccttctgctgcttcatcaattctattaaactgaaaaaaagcctccgcatatgcggaggctttgttatttcatcacattttgaatataagagccgaatgccgcgccggacatgcccggcgacacacggacgcggtgaagcccgtaaagtccctgatctctagacgccgctcccggctctgtcgtgaccgccatacggtagcctgacgaggcggcggcttttaatgtttctttattatatcgtccgacagggtagctgatcatagtcgtccgctgcccgaacatttgatcaaataaacgcttagagtccttcatttcacgtcgctgctgctgcggtgtgagcccgttcaattcgagatggttcatcgtatggctctgaatggaaatgccgtgggcggccatctccttcatctgcttctcagtcagatgattcttatgcccgataaagtttccgatcataaagattgtcgctttcatcttgtatttctttaaaatgggataggccgctttcacattgtctgtatagccgtcatcaaatgtgatcagaacacatttttcacgcggctccttatcctccgtcagcatcagataggcttcttcaggagtcatcgtataatagccgtgatcatgaagccacttcatatgctgccggaattcttccttcggcacacgcaggctgtttccctctgaaatgctgtgatacatcagaatcggcagtctcgccgtccctttcgtttgaacccaagcggacgtatccggctcttttttgatttgcctctttacggactttttttcgctgtgcgcttctgccttcggaatgctttgttcggcgcttgcctcatgacccgagcaggcggcaagtgtaaacacggcagccaaaaggcacatgcacatgatcatgcgtttcatcgttttcctgctttctgtcttctatttactttttatatcggttatgcgtcataaattgttacatcaaaaaaaccggacatccagctgtccggctttgcgttatgagcggattctgatttctgtttcactgtcaaaaaagtgagccttattcatgtcgaaagcgacggtcaattcctcaccggcacgaatgtcatggcgggcgtcaatccgggcgataaaatcctgatccccgatccgggaataaaccataatttctgacccaagcaattccgcgacattgattttagctgtgatggatgaattcttataagattctaccacaatcagctcgtcatgtatgtcttccgggcggatgccgaagatgatatctttgccggcataccctttttcccggagcattttcattttcccttccggcacgctgagagcggctgaaccgatctgaatggcgccgttcgtcagctttcctttgaaaaagttcatcgccggggagccgatgaacccgccgacaaatacgttttcaggatgttcatacacttctttcggggtgccgatctgctgaatttttccgtccttcatgactacgatgcgtgtcgccatcgtcagtgcttctgtttggtcgtgcgtcacatagattgtggttgtttgcagcctttggtggagcttaataatttcagcccgcatctgcacccgaagctttgcgtccagatttgacagcggctcatccattaaaaacactttggcgtccctgacaatcgcccgccctaatgcaacccgctgacgctgtccgccggagagcgccttcggtttgcggtgcagatactctgtgagccccagcattttcgccgcttcttcgacccgttttttaatctccggtttcggcatcttcctcagcttcagaccgaatgcgatattatcatagaccgtcatgtgcggatataacgcatagttttgaaacaccatggcgatatccctgtctttaggagcgatgtcattcactctcgtgtcaccgatatagaaatcgcccttcgtaatgtcttccagcccggctaccatccgcaaagttgtcgacttgccgcaacctgacggaccgacaaacacgataaactctttatctttaatatgaaggttaaaatcatcgacagccgcttctttttgatcgtaatacttataaatatgctcgagccgaagttccgccatgtatatccccctttatttgtaaacgctttcttaaataggattgtaacagcgtcagacggcggcggatataggcaatgttcataaaaaaagaccgctgtcttcgtgcacatttcccatttaatgtgatttttcatattgcagacaaatgaaataagccagcagggcgccccgatatgtcttaatatcaatacctgagcgttccgcaaatttatcaatccgatattgaagactgttgcggtgcaaatgcagttttttcgatgtgagcgacatgtttgagttatgttcaataaaagtctgaatcgtatgcttcagctccggttctttctgaaacagcagcgccgcttcttcgtgaagcaaggctgagagcttttctctgctttcctccgtgagcatggccggaaataccgtttccgcggtcagcgtgctcagctgcgggagatgacgccggccgatctgacaatattgctgttctctctgataatgaaggcgcagacgttcccccttgcagtaataccttccgacgaaaaaacggacactgaaataaaaatcgccttcgagaatcttcacaaaagatgcgatgtcatccgaatctggcgcttccagcttttcttcctccacaatcacgccatgatccctccccgtccggacaactgtatatgaaaccggccagaaatggcgcagcgcttccgtaaatgccccccagtcccgttctcccaataagtcataatggataaaacggacacgcggctccttgacatcaggcaccggaccttcttccagcagaaaacgccgccacctctttgctgccgccgtctccggaaaaaaaacgcctttttcttcagcgggcgtcaaaaatgattccagaagcagtttctccttcggggtgatatcctccttcggaatggcgacatagacccgtcttttctcatcataaaagcaaaagacatcctccgccgtacagcacgtatcagacaacacagccctcgggtaaattgccaataacgggttcatatgcgctcctttctatcgctctatcatattttcagtataaaacgtccggccgattgtatccacttcgttttaagaaacagctttcaggctatttcccgggaaacggatataaccgcttctgccggcataagaaaaaaaccctccgcgccggcagagggatcctttttatttagagatatcgacgaagccttcaccaaagacatcacgcacatcatgaacaatgacaaacgcttttgtatcacagcttttaataatttttttgagcatggaaagctcttgtttctggatgacgatatataaaatttccttcgactgccccgtgtaatttcctttacccgacagcagcgtaacccctctgtccatcagcgtgttgacctgttcagcgatttcgtgcttatgctcagatataattgtcaccgcttttttcgtattcaggccttcaatgataaagtccatcaccttcgttccgatgtacagcataacaatggtaaacatcattttttccgcaccgatgatgaaataagaactgaagacgacaatcagatcaaagaacaaaagcgcatagctgatattccaatcgagatatttgttcgcaatcctcgccaaaatggcagaacccgcagtcgtgccaccgactcgaataatgatcccgattccgacaccggcaaacacacccgcaaaaatagtattaataatgagttcatgtgaaggcgagtgccaatcatgcgtcagatgcagaaacagtgagttggcgacaacggtaatgatcgtataaagcgttgtttttccgtctaaaaatttatatccgataatcaataaaatcccgttcaaaatgatattcgtcaccccgggcgaccattcaaacacatagtacaagatcagggtgattcccgttaccccgccctctccaagatcattcggaatggcgaataaattaacggccaaagcaaagataaaagctccaataatcagcatcagcacatccagcaatctctttttcatcccagacactcccttttttataaaatcaaaaaagcccgggagagcactcttcattaaaagagcagaaactcccgggcttttatcccaacgtgtcacagcaggaacctgctgtgtgttttctctcggtccagaccaattcagcattgcggaaccctagaaaaccactgttttttatgttcagtttttatattatctttcaagattatacgggaaatcacgaacatgttcaaccactcttttttcattaaacctatggaaaatgcgaacgatctgccgatactaaaaaggaccttaaaatacatgactaaaaaatcattaaaatactttttttctcaaaatattattgactataggttattttacaggcattatagtatgtagtttttaagaaatagtttacataggaggaaatattatggcaggcaacctggtgtcttgtaaggcgtgcggcaaagaaatcgctaaaggcgttaaaaaatgcccaaactgcggtaaagatcagagaaactttttcatgagacataaaatcatcacattgcttctggcagtggtggttattatcattctcgtaaacatcggcggcggaggcggttcttcatcatctaaaactgcgtcttcaaaagctgcggaatctaaagaaaaactgtataacatcggtgacactgttaagactgagaaaactgaagttactgttacgaaagtggaaaaaagagattcagtaggctctcaatttgtcgagaaaaaagcgtctgacggcggcgttatcgtagctgttcaatacacggttaaaaatgtttcaaacaagccgttaagctctttctccattccaagagcgaaattagtagattctaaaggaacatcttatgattcagatattgatgcttcttcaagctatgcaacagaaacaaaagtagacaacagtaaaattttaagtgacttgaacccgaacattaaagtgactgacgtaaaagcttttgaagtggataaaaacgcatactctaaaggcacttggaaattaaagttcagcaacgatgttgaagtgaaaattaaataatcatcataacaaaagagaccctcatcatttgaaggtctctttctttttacaccttttggtacccgttcacattggaggactgccacttccaagagtcggcgcacatttcttcaagcccgcgctttgcttcccagcctaattcagccttcgctttggccgggtctgcgaagcatgcggcgatgtctcccgggcgccggtcggcaaaacggtacggcacttcttttcctgatactttttcaaacgccttgaccatctccagaacgctgtagcctcttcctgtgccgagattataggcgtcggcgcccgttgtgttcagcaccttttcgagcgctttgacatggccctcggcaaggtcaacgacatggatgtaatcccgcacgccggtgccgtcctttgtcggataatcattgccgaacacctgcaatcgctcaagcttgcccacagcgacttgtgcgacgtacggcattaaattattcgggatgccgttcgggtcttctccgatccggccgctcgggtgcgcgccgaacggattaaagtagcggagcagcgcaatgctccattcagagtccgcattatgcagatcgcgtaaaatctgttccagcatcagctttgtctgcccgtaaggattggtggcgcttaaaggaaaatcctcagtgatcggcgttgtttccggaacgccgtaaaccgtcgctgaagaactgaagacgatttttttcacaccgtgtgcctgcatggcttcacataaaataaacgttcccgtcagattattatgataataacggagcggaacagccacagactcaccgacggcttttaatcccgcaaaatgaatgacggcttcaatctcattttcagcaaacacccggtgaacggcggcacggtcaaggagatccgcttcataaaacacaagcccttttccggtaatgtctttcacacgctccaatgcttccggtgaactgtttgacagattatccagaaccacgatgtcatagccgccgtttaacagctcgacacatgtgtggcttccgatataacccgctccgcctgtcactaaaatcgccatgaagaaagcctcccctattgaatgaattgaccatattatatcggttttttcttcctcaatcatccatttccaaaaagtttaatcgtttagtcatcgtttcttcataatttattttcattcgcgtaaaaaacagagccctcgattcaaacgggttgtgaaatagaaatccctcccccgcgcatggtaagataagacaaaggagatgacggtatgaaaaatgaaatcattgaacgctttacctcttacgtaaaagtcgatacacagtctgacgaaaacaatgaaaactgcccttcaacccccggccagctgacattggccaacatgctggcagatgaattaaagtcgatcggcatgacagaaattacagtcgatgacaacgggtacgtcatggcgactctgccggcgaatacggataaagacgtgccgactgtcggttttctggctcacgtggataccgcgaccgattttaccggaaaaaatgtgaatcctcagattattgaaagctacgacgggcatgatatcgttctgaatgacaaactcaatgtcgtcctgtcgcctgagcaattcccggaactttcccgctataaaggccagacgctgattacaacagacggcacgacgctgctcggagccgacaacaaagcgggcattgccgaaatcatgacggcaatggcgtacttgatcaaacatccggacatcaagcacggaacgatccgggtcgcgttcacgcctgatgaagaaatcggcagaggccctcacaaattcgatgtcggccgcttcaacgccgcgttcgcctacacgatagacggaggccccctcggcgaactgcaatatgaaagctttaacgcagccgccgcaaagcttacttgttacggaaaaagcgtccacccgggaacggcgaaaaacaaaatggtcaacgcttcaaaaatcgcgatggaatttcatcacgcgctgccgaaagaagaagcgccggaatatacggaagggtatgaaggcttctatcatttactttccatggacggagacgtttctgaagccgccctgtcgtacatcatcagagattttgacagagaccgcttcgcagaacgaaaagaatatatgcagaaaaccgccgatgcgctggcggccaaatacggcaaggaaagcatcaagcttgaactgcgtgatcaatattacaacatgagagaaaaaatcgaaccggtcaaagagatagtcgatgtcgcgtatcaagccatgaaaaacctcgacatcgaaccgattatcgaaccgatccggggcggaaccgacggctcacagctctcttacatgggactgccgacaccgaacattttcacgggcggccaaaacttccacggaaaatatgaatacatttccgtcgatcatatggaaaaggcggtaaacgtcattgttgaaatcgccaggctctttgaagagcgcgcttaaaaccaaagccccctgctttggtttttttctttcacatgaaacctttccttctttctttccgtatataaggtatgaaatggaaagaaggagtgaagactatggcaagagggactgttgcgaaagaattgaaaaaaaccttaaaagacccgcgtgtactggagacaaaatcaaacccttttaaaaaactgcggaaaatgttcaaacgatttttttaagataacatctcgttttctttaaaaaaataaagaaagcgctgtcaactcgcagtcatctgttagaagcagttattttgcatatcataaggttttttagggtactgaataacacaaggcaaacgaaaacaccgaagtagttaattagacacttacaaaaaatagtaaaaaagttatataaacgatcatcattcatcagccgatacaatctatagaaccacaacaagagcaaaatttcttcaacccatagttatttttacggaaaatgacgttattttttaaaaaagtgacaattgtttgaatacttttcgtttgttttttcgtacaataataataccaaaactttttttgggaggtatgtaaaatgatgctacttattttcgctgctttgacagggtatcttgttttctctttcagtaaggacaaccgccggaaaacgccaaagacaagcccgctggtgacagctgccgacacgaataacatcattgatttaaatgcgatccgtcaaaaacgccggatgccgctatcataaaaacgacagctgccgcaaaatcggcagcctttttttatgcacccggccgatatgaaaccttccgcctccttttttcgtacaacataaaaaaggagtttttttatgtaccatttttacatcaaagagcgaatgtttacgtttaagaatcgttttcaagtgtttcttgaaagcggaaaagaagtctacaatgttgaaggaaagctgttttcattcggtgatgaactgaagctgactgatttggacggccgcacgctcgccagcgtcaatcagaaactgatgtcgctcgttccccgttacgagatttccgtcagcggcaaacccgtctgccaagtcatcaagaaagtcacgtttttcaaaccgaaatttgaaatttccggactcggctgggatcttaccggcgatgtgtggggccggaattttcaagtgacagacggaaaatcaaaccggatgaccgtcaccaaatcatggatgagctggggcgattcctatcatttgcagattgaaaaggaagaggatattgctctttgtcttgcgatcgccatcgtgatagatatgattctatttgagggtgacaaataaaaatatttatcgaaatatattgacaatataagaaaacatactaagattaagagtattacagtttattctgaaaaatagcatatttccttatcaagagaggtggagggactggccctatgatacccggcaaccgctgttcagcagaatggtgctaaatcctgaagataaggttgagatttgcggacgcaagctcttccctatccgagggaagagtttttttatatttcatcaggaaagaaggaatcgttcatgtcacagcaaaacacagaacaaccattgcatactcttctaagaaaaaacccgccgtttcgcgcggatcaggtcggaagcctgctgcggccggcggctgtgaagcaagcccgcctgcaaagagcggcgggtgagatttcggcagaacagctgcgcgaaatcgaaaacagagaaatcatccgcagcgtggaaaagcagaaagaaaccggcctcaatgtcgtgactgacggcgaattccgccgtgcctggtggcattttgattttctcgaaaatttagacggggttgaggcatttacgcctgaaagcggcattcagtttcacaacgtacagacgaaagcgcgcggcattaaagtaacgggagatattgatttttctcagcatccgatgctcgaagattataaattcctgcacagcattgccggcaatgctgttccgaaaatgaccatcccaagtccgaatatgctgtttttccgcggaaaattggaaaaagcggcctaccagaatgattacaaacaatttcagcacgatgtgtcaaaagcgtataaaaaagcgattcaggctttctatgacgccgggtgccgctaccttcagcttgatgacaccgcatgggccgttttcttatctgaagcggggcttcgtcagattgaagatttcggcacaacgccggatgagctgcgcaagctgtttgccgcttccattaatgacgcgatcaaggaccgccctgacgatctgaaggttacgatgcatatctgccgcggcaacttccaatccacatggacggctgaaggcggctatgatgcagcggctgaaacgatttttgacgggcttgaccttgacggattgttcctggaatatgatgattcccgctccggcggctttgaaccgctccgctatgtcaaacgctctgatcttcagcttgtgcttggattgattacatcaaaacatggcgaacttgaagacaaggacgcgattaaacgccggattgaagaagcttcacaatatgtcagcctggatcagctttgcctcagcccgcaatgcggattcgcctccactgaggaaggaaacctgatcacagaagaacagcaatgggcgaaactgcgtcatgtcgtcagcattgccggtgaagtctggaaataaaaaaaagacacgcgatcagcgtgtcttttctgtttacagaggaccggttccgattaaaatatcgatatctatcgtaatatccgccgcttttcggctgataaaccgccggatgctttcatcagtacatttccatgttaagggcgtcattttcacaagccgctcgaggtcaggctgcgataaggtcttcgtgtaacacagccgtttgcgctcaaaagtttgaaagcccgcttggaatcgtccggccgcagaatcggcggtgtcattccgccgaggactgtctccgaagaagaattcccttacttccttcaaataatcacgccgcggcaccgctttaatgactgtgccgccctttcgtaaaagcctgctgcattccttgtaattccaaggtgataaaacagacatcacgacatcaaaacagctgtcggcaaacggcgcatccgccacatcagcgacggcaaaaaccaaatgatccccgaaggcctttgcggcatgcagcacaccttctttcgagagatcaatgccgattcccgtcacggaaaaagcgggctgaagccatttgcatacggcggctaaatgagagccttctccgcatcccgcatccaatatcgccgccgttgtttgcggagattgaatgcggctgatgatggcggcgatctccttttgaaccgggacaaaaaattcccggctgtcaaaaagagcgcgtctcgcttcgaacagccgcctgtcatagcgggttttgaccgatttattgaggaaattcacatatccttgctttgatatatcaaatgtatgcccgtgtccgcacatcaagcttttgtattgtgagaccgccatggccgaactgcatagcggacacctgaatacggactggcatgattgcagtaattccgcgcgttttctttttatagacgtcaataaaaacacctcattcattcgttattccgatgaaatgaaaaaggcatagacaaataaacctcacttaattggaagtttcaacctatttatctatacctctcattatctgtaacgaatgaactgaatgatcacgaaaatgaccccttttctgccgtcttttgaaggcggtgccctcagatccattttatcagctgcatcccgtctttacaatgaaccggaactgtttttcgggggcttttatacctttattatccaattacttgtgaacatcctttattttctttatttataatataaatttattattttgaaaatatctaaaaaggttgattttcaaaaattgaaacgataaaatactgctatctcatgtaatatcgttattcttgtatatgatcagtaatatggtctgattgtttctacctagtgccgtaaaagactagactacaagaaagtttgcataaatttgaacgagtgaaaagcatatgatgctgtcagtctattcttttcttttggctcttatttatcacactttctggctttcaggaatttgtgacgaataagagctttttttatttccataatacccttataggagttgctcacatgtactttttattgaacattgtcggtctcattgttgtcatggctgttgttttcttatgctcacccaacaagaagaagattaaatggcgtccgattgtcatgctcctcgtctttgagtttctgattacttggtttatgttagggacaaaagtcggcggctttgtcatcgggaagatcggcgcgttctttacatggctgatttcctgcgccagtcaagggattgccttcgcctttccgtctgtcatggcgaacccgacggttgattttttcttcagcgcattgctgccgattatcttcgtcgtgaccttctttgatatgctgtcgtatttcggtattctgccgtggctcattgataaaatcggctggctgatttctaaaatatcccgtctgccgaagctggagagctttttctccatccagatgatgtttttaggaaatacggaagctttagccgtcatccgccagcagcttgccgccgtcagcaacaatcggcttctgacattcgggctgatgagcatgagcagcatcagcggttcgatcatcggatcgtacttgacgatggttccgtccacttatgtgtttacagccatcccgctgaattgcttaaacgcgcttttaatcgccaatatgctgaatcccgtggacgtttctaaagaggatgatattatttacgttccttcaaaagcggagaaaaaagacttcttctccacgatttctaacagtatgcttgtcggcatgaacatggtcattgttattttagcgatggtaatcggatatgtggcgttaacggctgcgttaaacggcgtactcggactgttcatgcacggtttgaccattcaaaagattttctcatacatcttcagtccgtttgccttccttctcggattaggcgtacatgacgcgatgtatgtcgcacagctgatgggcatcaagctcgcgacgaatgaatttgtggcaatggccgatctgaaagggcagctgaaatcacttccgccgcacacgattgccgtggctacgacattcctgacatcatttgcaaacttcagcaccatcggtatgatctacggatcttatcaatctctgcttgatggtgaaaaatcagccatcatcgggaaaaacgtctggaagctgcttgtaagcggaattgccgtttccttattgagcgcggcgattgtcggattgtttgtctggtaaaagaaaaaaagcgataccgctccgttttggagtgatatcgcttttttttattgatagacgaatgcaggcacgaaaacgtcccggattcctgccgcgtacggtccgagatcatattgtccgaacacaacggcaatgccgtttttcgtaaagaagaaaggtctttcgttattgaggatgatctcttgttttttgacgtcctggtcaaacagatcgttatgtttcttaatgtagccgtaaagatagtctctcgttttgttggctttcgtttttgtattcagcacatcattgagtgtgacccgattttttgcggccaggtcgtaattaaaggtctgaacggctgtcagcccgtgtgcgccgcctgtgtaactgtagttttccgtctgaatgctgagcttgccgccttgattatacttcaccttgaaatctgcctggtattccgctttgtagccttgtttttcaccgtcttttttgttttttacatattctttgtacgagttttcaatatagcgtttgaagtcctgattgattttcttttcaaaagatgcgtttcccgtatttgtgacctcggggtacgtcagctgctttacatgcttatacgtctggcttttgacgacgggctttgcggtttgcgcggcctctgctgaaggcgcgaaacctccgaacggcgcggctgtcagcacggttaagagcacggccgccatcattttgaatgcttttttcatcacaactcctccttttcattaccgttccctttttgaaaacggtttacactctatagacagcgcagatcagcaaattgtttctgggccttctttcacattttctccatgaaaaaagagacatggataatccacgcctcttttaccgtgaaggtctttgcgcaatggcttcataaacggcttccgccaaatcggagttgccgaacatctccaaaacgccgatgacggtttgatcaggaatcggttctgattcctccttcggcacgacaagctcttcagccgtttttagcagctcttcgtttaaaggctgtccggggtaagctttgctgtaaatggccatcggatcaaggtcatgattgacgcaccattgggcaaacaccaaaatcatcatgttttcgtcacgccggtaatattcttcgagttgtttttcggtaaacggcttcactatcaatcgctcctccagaaaatctacccctaagatacacaaacacagagcggaagtaaaccaaagagggtgaaacatattatttcatcaacccgcctgctttaaataatgcaatgccctgactgtcccggacagcggaaggtacggatttgcacggaagcaatttcgttttctcccaatattctttcacaaaaaaaaagcgcccctctcataaaaaggcgctttttcattcttatatgtttctgtgccaatgccgatgctcagccacggctttcagaaattgttcatggtttccgtccggaacaagaccggggccgctttcggttccggcggcgagggcgagaagttcttttccttcaccggaggcgccgatcgctttgtaatggctgaaagcttcgttgacgaagtctctggccgatttttgggctttgaggctgtctgtgctttgttttccgcccggaatgaaaacagcgtcgtacaggacggaatccgctgtcaggaacgtggctgacgcttcgagctccgtgccgttttctcccttgacggttccaagcacaggactgatgatatcggctctgactcccgcctgtttgcatgcgtcaagcacttgtttgactttctcatcagaaaacccgtggtcggttaaaaccgcaacctgccttgtcgctgccgtcttcaccgtgttttcctggcttaaggccggggaagtgaacgtttcatcagattcacggtccttcggcggcgggttcacgccgattcctttcgcaacacgctcggcaagcccggcgtcgacgtgactgaagacatcaaccacctgctgctgcacatccttgctgttcacttttccgacttcaaaacagaacgcggagatgatatgttctttctcggcgagagacatgctgttccagaacatcttggcctgagaaaaatagtcattgaagctctcactgcgctggcggatttttctgccttctactttttcctggtaatgaacgtatccgccttcttcttctgaggccggcgacggatcattgttctgcagggaatttttatgataggcgacagggcccttattaatcgtcatccggtggtagccgtcgtattggttgttatggaacgggcagaccggccgattgatcggaatctcatgaaaattcggcccgccaagacggatgagctgtgtatctgtataagagaaaagccggccttgaagaagcggatcattggtgaaatcaatgcccggcacgacatttcccgggtgaaaggcgacctgttccgtttccgcaaagacattgtcctgattgcggtcgagggtcatttttccgatcagcttgacgggaaccaactcctccggccacagcttcgtcggatcaaggatatcgaaatcaaatttaaattcatcttcttcgtcaatcatctgaacaccgagctcatactcgactttgccgccgttttcaatcgtttcccacaggtcgcggcggttgaaatcgggatctttcccggcaattttctgcgcttcatcccatacgagggaatgaacgccgagcacgggtttccagtggaatttgacaaagcgcgcttttcctttctcgttgacgaaacggaacgtatgcacaccgaagccctccatcatccgatagcttcgcgggatgccgcggtcagacatcgtccacatgaccatgtgcgcggattcaggattgtttgcgacaaaatcccagaacgtatcatgagccgtcgcagcctgcggcatttcattgtgcggttccggttttatggcgtgaacgagatccgggaatttgatcgcgtcctgaatgaagaacaccggaatattgtttccgacgaggtcatagttcccttcttcagtataaaacttcgtcgcaaatcccctggcgtcacggacggtgtcagctgaccccttggagcccgccactgttgagaaacggacgaaaacaggtgttttgacagacgggtcctgcaaaaatttcgcccgtgtatattccgtcatcggttcgtacacctgaaaatgcccatgaacgccgtacccgcgtgcatgaacaacccgttccggaatccgctcgtggtcaaagtgcgtcattttttcacgaaaatgaaaatcctccatcagcgtggggccgcggacgcccgcttttaaagaatgctcatcctcagacacgcgaagcccctgattggtcgtcatttttttgccgctgttatcagatcggtactgctccagctgttcgtcctttgagtgttcatttactcgtttgttttgatcatcactcatgtcagttcccccttctaaaacgaaacattctacagcacatttacccgcggcgttcttcaaataaactgctgatccgctcattaggattttaggtctgtatttacgtatgcggtcatacacattttgaaataagccattttcacagaaacaaaatgtgaaagcgcttaccaaaacagctgttgaacaggggaggtcatatcatgcttgccatactcggttttgtgatgatgattgtttttatgtaccttattatgtctaaccggctttccgcacttattgctttgattgtcgttcctgttgtgtttgccctgatcagcggatttggcaaagatcttggcgggatgatgattcagggtgttacagacctcgctcctaccgggattatgctgttattcgccatcctgtatttcggcattatgatcgactcaggcctgtttgatcctctcattgccaaaatcttatcgtttgtcaaaggagacccgttaaaaatcgccgtaggcacagcggttctgacgatgaccatttcgctggacggagatgggacaacaacgtatatgattacgattgcggcaatgctgcccctttacaaacggctcggcatgaaccgtttggtgctggcggggattgcgatgctcggttcgggcgtcatgaatattattccgtggggcggaccgacggcgagggttttggcttccttgaaattggacacgtcagaagtttttacgccgctgattcccgctatgatcgccggcgttctctgggtgatcgccgttgcttatctccttggaaaaaaagaacggaagcgtctcggcatcatttcgattgaacacgcgccgtcttctgatccggaggcggcgccgctgaagcgtcccgctctccagtggtttaacctgctgctgactgtcgctctgatggccgcgctgatcaccagcctgcttcccatccctgttctttttatgatcgcgttcgccatcgccttgatgatcaactatccaaatgtcgaagagcagcagaaacggatttcggcgcatgcgggtaatgcgttaaacgttgtctcaatggtgtttgcggcaggcatatttacaggcattctctcaggcacaaaaatggtcgatgcgatggcgcattctctcgtttccctcatccctgatgccatgggtccgcatctgccgttgatcacggcgattgccagcatgcctttcacctttttcatgtcgaatgacgccttttacttcggtgtccttcccatcatcgccgaagccgcttccgcttacggaatagatgccgctgaaatcggaagggcctccttgctggggcagcctgtgcatctgctcagcccgcttgtgccttccacctatctattggtcggaatggcaggcgtcagctttggcgaccatcaaaaattcactattaaatgggccgtgggaacaacgattgtaatgaccattgcggcgcttttgattgggattatttcgttttaattaaaaaaggatttccgctggcggaaatccttttctgtacattatttttttgtatagcgcacccagtcataatgagcgtatagcggatttacaccattgtaggaaccgagccagtcatcgacacctatcccattccacaagttcatcatgatctttcccggtgttgtcgggatttggcttgtcgcagtatgttttaattgcccatcgacataccattttatagagttcggctgccaatcgaacgcatacgtatgataggcattggccgcgtcaaatccgagatccgcaaccttctcatggtttcccgcgccatttgtataataattaaattgaacctttgtcgtgtcttttcctaaaaattcgatatcaatctcatcccaaggggtaccatccgttggacctgtataagtgaagaacgatgaaacgatccccgtgtttttagccggtttcattctgacttcataaagtccatagccataggtttgagcggagcggttctccccgcagtcaaacttgttataagacgggcttgtcagcgccaaacgcatttcacctgatgacgtcacggatacattatttgcacgccaagtgcagttgaacatatctccattggagtaaccatttgctttttgccagaaaccggagttatagctgttaaaaggttcaaaaaacgatccgcctgtttgagctgatgcagcagaagtgatcgcacacaaactcaaaaacaatccagtgacaagaatgagcagcactcgtttcatacgataaaacatgtcggcattcccctttctttgagagcgatttctttatcgatcatacatgattctgttaaaagggaacatcggtcagaataatgataataacgaatcttaaaaaaacctaaattaccatcagcacaaacagaaatgatccgcgctcattgtaatttaggttttgcatgcttatcagcaacaatcctaacaagatcatatgtgaatgtaagaaaaaatgaatccaagaacaataatgccaacgctttcattatgcttgtttgactaccctttctatgtgaatcgttaaatacagcagctcgtcactggtgagcttgtgctcatacgccctctcaatgcaagtttggattttcttcgtgcattcatacgcccggcggtatttttctccagcaaaaagtcgatgtgtgccgttaaaaagacgctgcgcgaaaaactttaagtgggtgacaaaccgataatagtgaagcgattcttcgttgaattcaatcttaaaatggtattttacgatactcaaaatctcttgcatgacttttgtaatgctgatgatattgggcatctcctcattcagctcggcatttacaatatgcagcgcaataaaacctgcttcatcctccggcagagacacgccagtcttgttttttaccatgatcagcgattcttttccgattgcaaattcgtctttgtagagccgcttcgtttcccacagcaaggcgtttttgatatccagccctttcttattgcgctgaatggcaaagttaatatggtcggtcagcgacacatagatgctgtcgttgagctttttgccaagctgtaatttcgcatagctgataatctcctcggatacttccatacactcgatcggaatatcatacaaaagggttttgaacttcggatacatctttgttatcgagggtgagcactttctcaatgcgggattcatctgccggatctcccgttttcttttgaaaagcaatgccccggcccattatgaccaattcctgattgccttctttgagcacactgacgacattatattaatgactttcgcaatcttcaattccgtctccctcccgcctgaccatttacctgctacaccttgattgtacatcctttttgtaccaggtcaatatctccaggtcaatcagaaaacgccgttcagaaatcattgtccaacgatgaggcagaggcgcatataatgcagagaaccggtttttgggaaggagcgtgtgtgatgaaacggttttcgaaagaagaaagcagctggatgctgtatgattgggccaattcagcttattcggtcattattatgacggcggtgttccccttgttttttaaagcggcggcggcggaaaacggcgtcagcgcagctgattccaccgcttatttgggctatacgattgccgccgcgacttttattttggcgatgctcagccccgtcttaggaacgattgccgactacaaaggatgcaagaaacggttttttgccttcttttttctgatcggtgtggcgggcaccgccgcgctggctttgattcccggcgaatcttggatgctgttattaatttgttatacgatttccacgatcggctttgccggatctaatgtgttttatgatgcgtttctcgttgatgtggccgcaaaggagcggatgaatatggtgtccgccagggggtttgggctgggctatatcggcagtacaatcccttttctcctgagcattgccgtgattctgtcagcacaagcggaggtgattccgctgtccgcccagactgcgggccgcattgcctttttaattacggcggcatggtggggactgttttcgattccgctccttctccgcgtccgccagcgctattatatcgagagggagccgcggcttgtgatcagcagttttatacggctggccggcacgctgaagcagatcaggaagcaccgggcgctgtttttgtttctgctcgcctatttcttctacatcgacggggtcggcaccatcattacgatgtccacgtcatacggggctgacctcggtatcagcgcggcaaatctgctgattgttttatttgtcactcaggtcgtcgccgcccctttttcaattttgtacgggcggctggccgaacggtttaagggaaaaacaatgctttatgccggcatcggcgtgtatatgattgtctgcacgtatgcttattttatggattccgcttttgatttctgggttttggctatgcttgtcgccacttcccaaggcggtattcaggcgctgagccgctcttactttgcaaagcttgtccccaaacagcacgccaatgagtttttcggcttttataatattttcggcaagttcgcttcgattatcggcccgcttttaattgccgtcaccgcccagctgaccggaaattcgtcagccgccgtgttcagcctgattttgttatttgtgatcggcattgccatccttgcgtttgtgcctgaggaaacggcgtaaaaaaagcctgcgcgcggcaggctttctattttatttcttggctttatggactttcagttttttgcctttgaccgtcgtatttttcatgatgtcaagaacgtgcgggccttttccgttcagaatttcgacgtacgatgcgttgtccagaatcgtgataatcccgatatcatcggctgaaacgccgtcgattttcgcgatcgtcccgacaaaatcgaccgctctgagttttttctttttcccgccgttaaagtacagcttcatgatgtctttgtttaactgttcgcttttgtctgttttgacatcggggcgggcgttcagtttttccgaaaaagccgctttccgttccgctgtttctttttccgacggcgcctcccgcttttggatgcggaaaccgatatatgtctcaatgtcatgcagaaaacgcgattcagaaggcgtcacaaacgtaacggccagtccgcggtgtccggcgcgccccgttcggccggtgcggtgcacatagctttctttttcaagcggaatatcataattgatgacgaggctgatgttttcaatatcaattcctctggcggcaacatcggtcgcaatgagatagcggaactcgccgcgtttgaattcattcatgacgtcaaagcggtcttcctgcaccatgccgccgtgaattttatcacaagggtagcccagcctgtccagctcatcggttaactggatgaccctttcttttgtccggcagaatatgatgcagctgtccgggttttcggtgatcaggacatcacgcagcaaagatgatttatcctcttcttctgttctggtgacaaaatgctcaatgtcttttgtcgtcaggccttccgcttttacttcaatcaattcagggtctttcatatatgtgcggctcagcttctcgacgtcatccggcagcgtcgctgaaaacaacatggtgactctgtttttcggcagatgctgaatgatggcttccacctgttcaataaatcccatattcagcatttcatccgcttcgtcaatcaccacatacgccagccgttcaagcggcagcgtccctttttctatgtgatcaagcacacgtcccggcgttccggcaacgacgtggcttttttgcttcagttcggttttctgtttgtcaaaagaagcttttccgaaaaccgccgtggcttttatccgtttgaaacggccgatattcgtgatatcttctttaatctgcgccgcaagctcgcgggtcggcgttaaaatcagggcctgcggtttgttttcctcccactccgcaagctcgcagatcggaatgccgaaagccgcggttttgccgctgcccgtctgcgatttgacgacgaggtcttttttttgcagcgcggcggggatgacgcgccgctgcacttcagtcggctcggtgtattgcaagccattcagcgcccgtcggatctcggggctgatcgcatattcattaaactcattcatgactaaactccttctctgtccggctcccctcattatacgcgaaatgccgccgctttaccctgacgttttgccgggccgttcgggggactgctttttcttcatgtcgagcacgacccatttggcgcaataaaagctcatgcttccttccccgtcatcgacatagtagcggatcgattcccagccgccgtcgaccgggctgatatccagatggatgtcggtgatgctttcaagatcatccagccgggcagacctcacatcctcaaaccgcagtacggcatcatactgtccgtcagtcagcttcagctcaaacaccgggattttatcataatactcgttatacccggtatagaacgtaaactccgtcaattcaaaacaacccggcgaacccggccccggcagaactgctttctcatgtttgtgccactccattttgcgcctccttacttaacaccttcttctctgctgcttcatattgacggcagtaaaaacggaacgtttggttctcccactcctccacgagaaaatgctgtccatcatctccgtcagcaggatcaattgctacaatgcctgagccagccgtttgactctccatttctcttatttgaacggaagaaacgtctttgcatgtgagccttacacgaatgagctgatgttcatactcagaggaaaacgccagctcaattacagaaatctctcgtccccgaaggaggcggaattctaaaagctcctgaatcagccacttattctttttcattttctataaattctcctatagaagcggcatacaactcaacatcggcagtctcatgatcccacagatagacagtctcctccattacactgtccgtctttttcaagcacagcttatccccggttccgttgtcggcaattacgatcaaatcgtcgggcatactctcttctctgcacacactgttttgcctgatcacatcatcccaggttttctgcaaacggctttgttcacggatagcgaaaaaaatccactctccgatctccgcagggttctttttatgaagcagccgtttatacgctttcggaaaagacgctctcaagcttttttccgcagccctgaactcttcttctgtcatcctgttattcctcccccgtaaaaacatgagattcatttgcaagcggtcttcacttttgaaataagacaggagagtttctttctatcgcccttattagcggtgagccaaaaaccgtaatggtttgctgccgcggatcccctagcagcccccactggaagtcctgatgaataaagaaacaatagtctccatttggaataacggagaccagccattcaccgaattcatctttatcaattggcgcatgaggattaaatagataacattcatgctgccagtccagcgcatatataaactcttgctttaaggtacaagattgaagtgcctttagtatctgcagtacgatgagttccactgcattcatggtcagaatgattgggtcgcttgtgtttatttttgtattgatttttgtaaagactaattccgacatgaacgcaccctttcttcatgcgttttcatataaccctgcacccaatcttttaattcttcaatcgtatgcagatacgaatcaggcgaatctttcagatcaaacccgctcaaatacacgagcatctcccaaacgttttcatcctcaacctccggatcatctgcagccacgtactcgcatgcccaatccgacacttcttccctcgccgcttgatcgttcaggatcagaccagccttcttcagacattctgctcttgtgggttctttcacttcacaatcctgcctttcattttttgtttaaaatgctgactaacagcctcctggcccgttcatgccgctcgatttcccggctgagctccggataatccattaaagcgtttttccgctgcgcatattgcggatacaactcaaaaaaggatttatataaggctttacgctgccgcgcagggatttgtttattcgccaaaacaaaatctaagctgccgcagacaagtgcgaagtattcataaaaatccccagcgcaggcagcaccctcaaagtcttcttcgaatctcccagcatctgaaggcagcggcccctctaattcttttttgtataatttcaggtttcggatgacgtcatcatttaaagaatatctgatggatcttatcatctcattttgatgcttttccattactgatatcccgcttataaatccccgaattcgagaccgcgtaaatggcatcgccagtcagcttcagctgatgcccggaaagctcatcgccatccgcatcacagcacgttatctcttgcatcggcagactgacatcggccggaatgagagacagtgaatgatcatctttgcatacccaaaacccgttatctgaaatcgctagctggtcgtaaaccccggaatatgctttatcagaaataatccacactcgtttcacgtcggtttcttcaaacgcagcaatgactgtataagcgtaatacagcatgtagattagtccgtctttttctgcaagtgcataacagtcatctacaacgggcgcatatatttctgaaagctgttgatcaatatgcgtttcctttaattgcccgtctaaagtgaagcacagcacactttgaccatttgagttttcatcatcataaatgccttcatcacttaaaccgatccataggttttgtttctcatccagaagactgcatgaagcccctgaaggcagagaaaatacactttgttcttttccatctgttgaaaatactttcactttatactcatgcgattcaaagaaaatcagcacatacctgtcatccgaactctgttgaaacagcataatatcctcacacggaatttgttcatcgatatgaacctctcgggtgtcgccggattcctccgtgatcgtaaacgaaagactgccattctgatgccgtccgagatacagacgcccccggtcatcaaaatggatgaaacatccttttactggttcgtcatgtagcttgttcatttttattttcatgtaattgccccttgctatttataatgagcggcgagctttctttgaaattcatccggaacgatctgattcgggaatacaactgatatccagtctaaaacacggtcgtctaagggcctccatgatcctaacgtttttcccgcaatctcctgatcaatacctagaatacagatttcaaaatctctctctccgtaaatcgcccactttaaagtcggtgaagcccatacgacgcgggatgcaatattcattatgctgtcatttttactgtactttggataatcagttaagattgaaagatattcatcttcggttatatttaaaggaatctttaaccagttaaaatatccgaattcctcgtaaaaccgattcatatcatccggttgtgtcagaacagccattaagataaattcatcgtgatgatgatgcgccaaacttttgagcatttcccagccttcttcagacaagacccagtggaattcttcgaatagataataatgttttcgttgtttaaaaacttgttcgggcaacgctttgtcttcatgaaataaagaatatatttgaaattgaaagactgccgattcctttgtgttctttataaaaaagggatgcatcttgtacctcttttcggcggtttacacacaagctcacagccgtattctgtgtgaaataaacagacagaaaatgagaaggacggctccactaaaatacagctgttagaaagcagccggccttcaaaatctataaaatccatgagacagtgcagatgacttgcacaatccttcagcgcacatttgatagcaccgacttcattactatacggatgaaacagataaacaatatcattcatccgttcaacccccgtatccgcaatgttttctaaaataagcgatatggctgtctccttgtcgcttatatcaacttcacgcactgcacttgggaaagaattcgataatatagtctcaaatatctgcctgctttgttctgcctcagctaattgataaacaaaccctgattcttcacaagatcttagcgaggcacgcacctgtttcattaaaaaatgcctcttgttttcctcaagcttgtcaattaacttttctctcatcactgaacacttccttacaggatattttcattctgccggcatgtatgctgcatagaagtaatcaatacttcaccagatataaatcgttatcactaaagataaacatgcgatcctgtacggctctgtacgttgtttctccttttctatcaataccgtgtatcatgacgtcagtctctttgtgctcttcatgaaatgcaaatagggtatcatcgtgactctgaatcagcagcaccctttttttcgaaacggatagctgatcacaataggagtattgatcgccgtttagcacatattctgcaacagtacgaattctgtcccgtccaatctgataatgaccgatgacacagcaatcctctccctcaaaacatacatacaaatcagatttgatcgattgtatggcgtagcattcgtgcatcatttctttaaaatcgtctttaaaataaaacgttctgtcttctgcatgaaaagcaaatatcgctttcccttgagggtttctctcatcatacataccctcgtctgttaatccgatccatagtaatccatcctcacccagatgaaatacattggcgcttaatagaaaagaacaaatcggattgattttattactgtttacgcagtatacagctaattgacacgtatgattttccaggtaaacgatcacgatagtgtcatcatacgaatcaaccagatagaaatgggcatcttcagaaaatccgtgtaactcttttttgattaaaagagagctgcctttcataacctccaatattactttgtgatcatgcaccgacacaataaatacttgatcatcccgacccgcattgaaataaatgatattttccctttcatatgacccaacacgctccgcggtaagttctaacatcagcaacactccgttgatttaattatttttcagtacggaaaacttgttctcagtttcccattcggctgaacaaccactctaaccctttttgtcttcttccccctactatttattccaacataccttttaaattttttttcgtatacagtagcacctgaatgacctggtctagcttttcctctttttaatgtgtgtctggtcgttcttttcattgctctattgctcttgaattttcctttattagggattttagatttaggtgcgtgacccttctttatatgtttccagtcaatttgctttacttttctggaactgctcgcaaacttataaacccttttagcacccttaaataacttcccaggaccaaagttcgaagccgctgcccaggctgcacctctccatcctttacctgatttatatgccttatatccgtcataagccgcaaagccggcgttaatggctagccacacccaatgcccatctggatcaacattcatcaccgggttgttgtttccgtatgcatatccattctgatctaaagaatcgccgtcacttcccgggtctgggtctagtgataagaatacaccgtttcttggttcgtagtagcgggccatgagatagtacaggccggtttcttcgtcgtattggtagcctgcgtagcggtagcggttgtcttttacttcgtcgctcgcttcggtttttgtcggatttccccacgcatcgtactgatatttggcaacggtttttccggtgctgtctgagatggcgatgacgtcgccgtgtgcgttgtagtgatagaaatatttcttgccgttctctgtataggataacagctggccgctgtcaccgtacgtatatgattttgtgacgttgttgtcggcgtctgtttcatacagaacgttcaagctgtctccgtcatagaagtagttcgtaacgtttccgttgacggttttttggattctgtttcctttttcatcgtatttgtatgttgcgaacggcttgtcttcgcctttttttgtgacggcggtcaggttgtcttccgcgtcccacgtatatgtgtatttgccgtcagatgtgcggttgccgtttttatcataggacaggtcttcgtcattcaccttcgtcagctggttcatgatgttgaaggatgcgttgactgatttgcttgcgccgtcctttgtggtggtaacatttgtccggttgccgaagccgtcgtacgtatattgaatgacggtgccgtcttcatgagtttctttgacgagctggttgagcttgccgtattcgtactgcacctttccgccggctgagctgtcgatgaccgtgcggttgccgttggcgtcgtattcatagctttcccggaagatgctgccgccgtttttggctccgatatgaagagagctgacgagattccgctcatcatacgagaagctcgtgccgacttcattgccgctgatgaatgtctggacattgccgttttcatcataatcaaatgtataggctgaagtgccgtcgttcatttcaatcatttgatcaagtttgttgtacgtaaagctgtttgttcctttttggccgccgtggctccatgagaaagttttcagcttatctgaatcagccggatacgtccagctttggctgccgccgcggtcggttaattcggtcaggcggtttttgttgtcaaaggtgcgttttttcgttgtattttgttctttgtttgtgactgacgtttcattgccgtttttgtcataggtaaagttgtatttttcagtgccgttatacgcttttgacttaacccggtcggtgccgtcataggtcagcgacacttcattgccgttggcggaaacggttttcgtcaggttgctgttggcgtcatattcactcttcagtacattgccgagcgggtcggttgttttgacgagcttgcccatgacgtcatattcatattgataggtctggtctgcgccggcccgaatcgtttttgtcagctcatttccttccttgtcatagctgtgaaggatggatgtgccgtttgacagggtcagctttgtcagctggtcggcctgatcgtattcgtaggcggttgtttcgcctttcgcgtcggtttcagacattttcttgccagtctcgtcatatgaagcagtgcttgcataacctagttcgtcttcttcttttgtgacgtagtttcctttttcgtcataggtgtttttcgtcaggatgcttccttcgattaatcggatgtcatcaaaccacgccgttcctgtggcgcttttttggaatagaatgctgatttcgattttattgatcggctttgttttcggaatgactgccgccgcccggttccattcctgtgtcccctgcgggaatttggcggtgtagacgcctgtcgtgccgtccgcataggtgacgccggcctgaagcgcgtaatcattgtcgttcgttaattttacgccgtcagccttggacatccctgtcagcgtgatatataccggcttatcgtccgcgctttggcctaatgtaatggtttgttttgcggccgcattggcttgtgatgcatttgtgcgggacgcttttaatgagctgtcatcatcgaagccttcatcaaggtcagcggcggttccgcttgtgctccatccgtctgttttggccgtgaaactgctgttttgaaccgggttatagcttgaagagacttcgcctttttccagctgaacctgatcaaaccacgcttttcctttgccgtccttgtctttatgatccacttccatatagacgatggcttttcctgcattggccggtgttgtaaatgtaatctgccgtttcgtccagtcattctttccggctaatgcgcctgattcattgtgaatccattgaatgcgtttttggtctttgtcacgcagatcaatgttgaaatacgctctcgcctttgtcagatccgttttgatctggccgctgagtgtatacgtcgtattcggctcaagctgcacttcctgcgttgcggacgcatggccgtgctctgttccggctgaagcggattgtgaggtgatctccagtgctttttgtccggacagcgcgccgcttcttgcttttacagacgcgatgcttccgctgtctctcgtagcggtgagattccagcccagctttgttgcttcaaagctgccgtctttcagcaggcttgccgaagctgccagctctttgcttgattgaatgagattaccgtatttgtcatacacggcggcggatgaggattttccgctttgatccgtttcagaaacggcatccagtccgtcgtacgcaatatcagtgatgttcccctcggtatccttcattttcgttacgtcattgtttttgttgtactgatacgtttcggtgccgtagttgtcttttacggctgtgacgttgccgtctttatcatattgatagctttctgtcgctttgcccgcatccgcgtcgttcggatcggtgtcctgaatgacgttgttgccttcgtatacagtgttggtcgtgattttcagcccttcggcatcatcgatcatctgaatcgggttgcccgcctcattatagccgtactgcactttgcggccgttcggctgcgtcatgagcagcgtttttttgtccgcgtcatagctgtagtcgtacgtttcttttttcgcattgacggctttggtcagacggtggccgctgtattggtattcagtgaacagcggtttgtcacccgtgctgtttgcggaatactgcttgacgaggcgcccttcggcatcatagtcgtagcttgtgacgctgccgtcagtatccgtcacctttttgagaaggtctttgtcatatgaatacgaaatctttttgtttttcggccctgtaagagatgtgacatggccgttttcatcataggtaaatgtcagcttgcgccctgatgcgtctgttatggcggtcagctgattgctgtcgttatattcgtatacggttgtgttgttgtgtccgtcaacgactttttgaagcttgccgccttttttgctgaaataagcgttcgtctgatcctttgtttttaatacaaattggtcgcttgtttctgtcagttcgagataaacacccgtcggcggctgatacgtgccgtcagattttttcgtgaagacatgtgttgtcgcgtcctcatcaatataaacggctctgccgtcttcagaaaggatcgacgtttccgcatcggcataccagccttggccgaacatatggtcagagctgtcaaggctgttgaaggtccgggagagtccgagccccggtccgcgtccgtcgattgacatatcttcttcattgacgatgacatttcccgtcgctccgttcagctgtccgtccggaatgtcgataatagaccagaattcttccgttccgaggaattccgcaccttcatggaaaacagggttaaaaggtgccgtcggtatgctgtcaccgtttgcgtcataggcggtcagcgtaaaggaatagttcttcttccctttgtaattgccgtttgcgttttcgtaaacaggtgaagggtcaagcgccagttcgccgccctttccgtccttgtgaagctggaattttcccgctttcacttcatcggctgacggccagatgtgtttgttttgggtcgtccaatgatcggtatccccgacatcgaatgattgatagtcttttccgttgtagatgttgattttgtagcctttggcgtttttgactttatcccatatgagattgacataacccgtttggctcgatttcgtgttcgtatagacgtagcctgtcagatttttcggctttgcgatatcaggcagcgccggactagcttccggtgaggcgatcgcttctccgtctttgttataggcgattactttaaatccgtatgttttccggtttgcgtctccgccggcgtttttataaacggggcccgggttaatcggcaattccgcgccttttttgtctttcaggtgaagcgcatattttccggcgctgatttccgcctttgtcggccagatgttttgatcttttgtggaccaggatgttttatttccgaggtcaagcgtttcaaagcctttgccgttaaagacttgcattttatacccggctgcgcctgatacggctttccaggaaagatcaaaccagcctgtggcgttgttgttattaaagcctttcgtgcttggtttctgaactctgccaatattcggaatgacgggcttggcggccgcagacatggcgccttctccctggtcaaacaccgcgctgaccgcgacccagtaatttttacttgccggatagctgccgccggagtttttatagaccggcgaaggattaagcgctaattcacttccgccttttccgtctgtatgcagcttatatttgccggagtcgatttccgcttttgtcggccagatgttttttccttttgtgctccaagaggttgcattgccgacagaaatggcttgatattctttcccgttataaagccacactttatagcttttggcgccttcagcttttttccagctgatattgaaaaatcctgtcgaatctccgttatgatacgctttgacagacggcgtgtccgccttcggaatcgtgtatgtcacttcaatgtatggttttttagcagagtttgctgatgacatcagcttcttccaatattcttttccgttgccgtttgtgtgaagcttaaagccgtaattggcgccgccgttgttccacgacttgactgcggatgtgacatcgaagcttgcccattggcctttatagacctcggctttgccgatgtttttggagcccggcttgtttttccacgtgatcttggcattgtcgtaattgctgtttacggtgtcgagccaaagccccgtcgcctttgatccgtaataggagtggactgtgtatgctttaagcgtcgcttttgtcaccgtcatgtttttgatcggctttagattatcaaacttcataaatgcgtagttcgttccggttgtgccgtcataatatccagttttcagcacgtacgctttcaatccggcatcccatttctgcgatgcggcagagtagtttgtcgtcgggtacgcgctcatgacaaaggtatcggatgacacggatactgatgtcgacgggtcaatagataccggataaacccgcttgggatctttcagccatttttcatcggccgttacatgcagcaagtagccttcgctgtttttctcaagcttgaagctgacatcttctgacctgctgacttcacctgacttctcgtcgagatctgagtcggtcataaagggcttcggcacggtgtagacgacattgtctttgtcatcagaaaacgcgatcgagccgtcttcctgttctcttgcctgaaggtcggttttgatttgaaaggtgaaggaattgtagccttcatatttgtgaagcacaaggtcttcttttatgttttcgttaaatgtgtaggtttgtaaatcaatagcaggaaacacttgctgatacgtaagctcgttgctgtcttccttcacttttgctgaggcatctgtcggagtgattgcagcctgatcggggccttttgcgccggttaatgagtatgtgagcttataatcatcatgttcaaatgtagcgtataatccgtttttcatttgcttcagaaaatcggagttcagcactgtattttccgtcccgacatcctttgagccggttttcaattcaggggaaacgtcttcccagtccgcattggcggtttctttcgtgtgaatggggtctgtgtagatttcctgtttgtatacaccttcgccctcataataaagctttgaattcacagttctttcagacgtgatctcaccgtcttgattgatatctttttgatcaaacggcatctgctcggatgctttttccgccggaagatctttttccgggtctgctgccggaatggcggcggttttcgcttgatcttgtttttcacgcgtttctgccgcaaatacatcggcaggcgcaatggaaatcataagcgttgccgcaagagtgccggccagccattttttccacttgttcttttttcctattttcataggttctcctccttcttttgtaatataggcttaacaatagtaatattattgaaattgtttatcaatattttcctaggtatttaaggttattttaaggattataggaattttgaaccttttattcatataaaaaaaccgccggctgccggcggttttttgtattatggatagcggagatttgtattttgcgctcccgcgtaggattgggcgaagtttttggcgtcctgggctgaaagcgtgccgtagctgtaatttgatctcggattccagccggtgcgcggtgatttcggggctttgagcgacgggaatgaaccgatgtcggtgaattgggccgtcccgtagtcgtctatcattccgcctttttcatttccgttaccgaaatagttggcttctgagaagacagtcgcgtttgtatgaatggtgaatcctaaattgaaattggtcacatagttgttttttgcgtgaaaatagccgtatctcatcaggcccggtgaacgcacatagacgttattaaaatagttgttggtgatcgtcatatgcggatagccgatataattgcgtccttcgttatcatcattcggataaccgagaatcaggccgtacagatggtctgtgaatttagagttagacagcgtcacaaaatccgctttggcgccgacatacagaagcttgcccaaatcgctgtggctgttcggattgtagctgtgtccttcaaaccacacgtggtcaatccagtaattctgcccgttcgctatgtacatcggaatgtcgttgttgcctgtaatggcggcattatggctgataatgagatttttgaaaatcacattgtttgatccggagccggtggtcagatagatgttggtcagcctgtggctggtataagagccgacgatggttttattggcgccgactgtcacaacggctttccccggggaagaaatatcacttgtgatgacgatggttttgcggtccgttccgcccgcattgtttttcagatcattgagattgctgacgtagacgacggggccgccctggcctcccgatacggcggattttgcttttccgttatgatccttcgcattgccagcgaatccggtaagtccctgcatcacatccggataagccgctgccgcttctgcctgcttggatgcggaacatacgatggccagacaaagcgcaaagccgagtgcagccaagaaagcgagatgacgcgtcttctttttcatgcccttcactcctttaatctcttaaattgcaaacacatgaagtattatacaattactatcctctttttccatgatctgtttgtctgctttttcgttatggctgaaaagccccaaaataaaaaaagcagccggtacggccgcctatatacgggtgctgtctgcctgagtttccgtcggcacggctttttgctttcgaatcagggacaacgccattcccgcaaaaatcaatacaatccccaaagattgataaaggtcggggcgaaaccccgtaaatacggtgtcaagcacaatcgccaccgccggatcaagaaatacgatgattgatataaaccgggtggataaaaaccgcaagctgtcaaaaaagagcaaatacacaattcccgtatgaatgataccggttgacacaatcatgatccagttcacatgcgacaaatcagaaaaagcgccgaaacggacgaacgggagaagaatgataacgcccaatccggtctgcaaacaggtgaccgcatatgggctgagactgttgatacctttcccggccagtgtcgtaaaggcgtaaaaaagggcggccagcacggcccaaataatacccgattccatcagctgagaaaatgacgtacttccgttgatgccggaaatcagggcggtgcccagaaaacaaatcacgatggaagtgacggacacaatatgcagtttctcccggtatataaggctccctagaagaaggacgagaaccggagccagatgataaacggaaatcgctatcgtcactgatgtttcctcaaatgatttaaataaaaacacccagttcagcacgagaaaaaatccgcaggccaatgtctgcaacacctcgcgccggttccattgttcggtgcggtgccgtccggaaccaaaccagcaaacgcccagaaacaaagaggcgcacagacatctcacaaagaccagttcaattgaaggaacattcgtatgttccgagaaaaagccgattgatccgaaaatgaccatggaaatgaccattttgatgacggcatttgatgtttgttcagcttgcattgattcgcttcccccatatcattgactgtttattcagacaaatactaacagccattttacttgattcagaggaagatttcatcctatttttcgaaagacggcggtcttttctcattaaaaaaagcccccgcatcagcagggccttctgtttaatgaacgatcagtacaggacaaggagacaattgtgagaccttatggctcacgcttccgagcatcatttctttaaatccgctgattccgcggcttccgacgacaatcagattgaaatgctgttctttcgctatgtttaaaatttgatgcgcaggttcgccttggacgtacaggctttccgcatttaccccgctttctgccgctttctgcttggcatcttccagaatggccgctcctttttgctcgacttcatgtttgatgtcttcaatgaagttttccggaacatagacaatccctgttaaggctgatgtggatacaacagcttcacgtcccgcataaagaatggtgagttgagcctgctgttctttcgccagatggatcgctgcgtccaaagctttgctgctcatgtctgaaccgtctactgctgcaagaatttttttaaacatatgaatcccgcctttctgcttttattgtcctcctctctttgctgaatgtcaattttgccggctttctccggaacattgcgcttacagactttctccgtttgtggcgatgacgtctttataccaaaccaaactacctcagcgttattttttaagcgcttaataaataggactttattctcttctttttcagtattacctattggtaaaagtagtgataaaatggaattattgatataaaaaaggagattatgatgagaaatcatagaggcttccatgaggaaattcagcaacaacaaaaactttatccaacatcacatcgcattcaaccggtcagcccaaaagaatatgcagaggttttgactttacatacggcaaaacaactgagcgagacatttcaaacacttgtggatcaagatcagtatgaacaagcgattcagctgagcgagaaggttgcctctcagcttggaaaacatacgaatttttcattgccactttccacagtgctttatagtttaaatgaaatggaacttcctatttcagaggaattttctctacatcgtctgaaactgctaggaaatcatcaaactcatgagaactttttcaaagcattaaaacacgaaatgttaacggcggatcgggtagactttatggttagtttcacaaggtggtctggtgttcagcttttgatccctccgcttcaggagcttgctaaaagacatgtccctgtacgcatcattacatctacctatatgggtattacagaaccgaaggcgttaagacatcttcttcaatttgaaaatgttgagttgagaattgtaaatgaatataaaaaatctttccatacgaaagcatacttatttgaacgctgttctggacagcatagtgtcattgtaggatcttcaaatctatcacaagctgcccttacgactgggtatgagttaaatgtgagactacctgaaaccagatatctccccgtttatcaacaaacaaaagatttgtttgacactgtttggaatgaaaagacacagcctgttgacgaacaatttttacaagcctatgaggaattccaagctggaagccaaaaggtaagtgcttcctttgctgctcaaaactctctttacaaaacgaaaatgtccccgaatgccatgcaaaaggaagcattacgaaaccttaaaaaaacaagaaacgaaggggagacaaaagcagtcatcatcgccgccactggaaccggaaaaacatttttagcagcatttgattttgagcaatttaaaccaaataaatatctttttcttgcccaccgggaagagttactttcaaaagcaatcgaaacattcaagaaagtcacaaataatcatgaagattttggcttattaactggcacgaaaaaagaaagagataagctttttttatttagcactgtacaaacgttacataaaaaagatactttggaatctttttcaacagatgagtttgactacattgtgattgatgaattccatcatgcagaagcatctacctatcaagctgtattaaactactttacaccaaagtttttattaggtttaactgcaacaccagagcgtcttgacggtaaagatgtgcttcagatttgtgatcataatgttgtttatgaaatcagactccgcgatgccctaaaggcagagctacttgcgccatttcactattttggaatttcagatcatactgtagattacgaaaaagtaaaagtgaaaaatggactgtacgaagagaaatcgctagtcgatcatttaaaaacgcataaacgagtagaatatatcatcaagatgatcaacatgtatggattctacggcgagaaaatggttggcttaggtttctgtacaaacgtcgaacacgcaatatacatgagtgatgaatttaataaattgggtttttatacaacttatttaacaggaaatgattttcctgcaaaaagacaagaggtcattcgtcaattggaggatcggcaccacagtttagaacttatatttacagtagatattttcaacgaaggaatagatattccaaagctcaatctactattgttccttagaccaacagaatcaccaacgattttcattcagcaattaggacggggacttagaaaaactgacgacaaagagtttgtaacaatactggattttatcggaaactatcaaaagtcattcgttattccactcgcactatctggacaaacaagccaaaaatcttttgataaagattccctccgagtggccgtgacgcatgagttttcagatttacctggaggatcttatgttgacctttcagccgtaacgaagaaagaaattttaaataagatcgatcatattaaactaaattcagatgccatgctgaaaacgttatacaagcaatttaaacaagagctagggcgctctccagaattaattgattttctatactctgaacaggcacctgggcttaccttttttataaagaaatacaaatcgtgggtacagaccaaaaagaaaatggacgatttgaatgttacagatgaagggattctcaataaccccttggttgtagggatagtagcaagattagaacagcaattacctattaaatggccttatgaatggttaattttacagagcggttttcacaaaaatatcatcacaatagaagatgtaaaagaatcgttagaaaaacagtttcatattcaaatcacaacagatacacatgatgacctcattcagcgagcaatggagcgtttaacgaaatcagatcaaaaacagaattggcgctttggtacattacaaggtgatacattcaagttagatccagaagtaagcgagattttaaccgatccattattcggaccgtatattaaggagcgcgtccactatggactgattgaatttagacgtatgaacaatatagaagcccttgcttcaaaagagattaagctaacattgtatcagacctatacaagaaatgagctcatttatctttttcagtcaactgatcaggaagggacttggcgagagggtgtacgtagagttaaaaatcactatttaatctttatcaatttgaataagtcagaaaaagtagaagatcatttgctatataaagattattttattgatcctagccattttcactggcaaagtcaaaaccaaacctcacatatatcaagcgtagggcaaaactttattcaccataaggaaaaaggataccatattcatttatttgtgaggaaattcactgaaatgcacaacatcactttaccatttatttatttaggagaagcggattacgtatcaagccacggagacaagccaatgaatgtcaaatggaagctccatcagcctgtcccagaaaacttgtatgtggatttaacgaattaaagcagatacggtcggaagatcagcgggtgcccactctagtgattctagctcacgaataggcacccatctgaattccgcatgctcttttgctaccggcttccctgatacaatcctcgcttttattgaaattaaattgacgatgaccttctcatattcatgatgaatatcagctatcacatcgcccgtaacaattttacaatcaagttcctcttcaatttctcttacaagtgcttcccgagcattctccccttcttcaagctttccaccaggaaactcccacagattaggaagagacattgttggagaacgtagagcacatagaatttcattgttttcattttgtataactgcggcggctacttttattgtttttttcaaaattaaacttcctttcgttttttcttagtcggtagctcagttaaattactatttaattataatttatgttaggaaagcttttttctattttctgaaagagttcagttggttaacaaaattctcacatcttgaatttcttgttagttcacttttattatataaaaaaatagcactttttataaggaggttaaaaatgtgattatcctcatttgtcaaggtcgttttcttataaatgcttattcaaaaacagttttatacgctcaggctctctactttcgttagttctcaatctgagtatgggtattcctgctttatctaaaattgtgtttttaattctatctcgtctcttttgatctttagagtgatggtatgcaacaccatctacctcaattactccaagaggttcattacccatcttataatgaagaagaaaatcaactcttgccgctgttttaataaattgtttttcatcttcatgtaggtgacttgtttcattcaccagatctttcaaacgatactctcttttaaagttgatttttttaaatttttcttctgaaagaatatccctaagtaagctggctataattctttctgtcttgtattttgaatcacttttccgaagtctattttctctttcaataagtacttcagagaattctttataaagtaagtcaaacactgaaattactttgctttcatggtataaactcgattcagtatagtattccatatacctaataagttcggaaatttctttgttgctttttttaaatacttcaacatcagatactaaaacaaaacgctttttagctcgtgatatagcgacatttattaaatttgcgctatcaacgaactgaacatcatttttacttccttttttatcaagcacagtagaaaaaataataccatcgcattctcttccctggaatttatgaactgtatctttcaaaatctcctcaggaaaacgctgttcggcatgattaatctgttctctataaggagcaataaagcctgtttcataagattcaggaaacacaagatttttaatcgcatcctcatcaagagaatctaattcacgaatattatgtttcccaccctgaaaccgcatatgattacctttaacagtcttaatgagtacgatggaaggttcattttcacttttttgttttgtcaaaggaataagtttcccatcataatattgttcattacaaaatttaattatcatcggctcacaacgataatgttcttttagaagagtaatcggtattcgattcttatatacttttataatcgaatcaagcatactattattaacataattaaagcatgattctatttcaaattgggaaagctcggctgatgtatcgggaatgtgggggagctgcttcctatctcctactatcacaacattcttagcacacccaagagcaagtatccctggcattaattctaattgcgaggcttcatctataattaagtaatcaaacaaaaaacccgcaggtatagacttttgcaacgaaaaagcagtactcaatataatggggaattgatctataaatgatgaaaaatatctagactttttgaaattttcctgagtataatgggtttttctgttgaaatccccctttttattcaaataacttttaaaaagttgttttgagattaattgaattctttccgttaaatcattgaagtttttcatttccagaatgtcttcaattcttttaatttcactttttaattcctcaagctttagtcgataaaaatgatattgaagctgtgtaatgattttttctttataagattgatcttttatttgtttcgggctgtataagccataataaaaaagatattttgtttgtttaaacaatgtcattctattcttatgatttaatgcctcatcaaccaaaaaatcgatgatcttatttttcgtgaatttgtaaaatggtagaagttttggttgaacagcttctagtgattctaaatgttttgtataatatttctgttccgtttcaagatcttttatttgctgctttatgactgcttgtttgttttgtaattcaagtaactctttcattgatctaatattgttccacagaatttgttccatttctacttcaacatccatattaatttcccagctattgaagtcttggggaagctttggaggattctcaaaaaatttcttctgattcacctgacttcctaatgatgcaagaaaaaaacctagatctgacttcattaatttctcactgacatttgcgacggcagaattattactcgatacaatagcagcattttttccttgcattacaatgttagaaacaatattcaggatagtttgtgtcttaccggttcctggcggtccttcaattacgctaacctgagaagaaaaagcagattcaaccgcttgaatttgactaagattcaaaccaaacggatatataagctttttttccttattgaaggattgactagtttttgtaaaataagcatgaagagcactttctgttcttagaggaaggttatgaatttgcccttctaaaatagcaggtataccattaactgttctatcctttaccccagctatgaaagaaaaataatttaacaggtttttgaatttagcattctctagccttactttcttaaccgcatcttttttataaatatatctttgcttaccacccctgaaagaaacaaccgcatatcgatgttcttactaatctcaccatttaattcaaaaacttcatcttcacttaacgtaagttgttcaaatggatatactttgcaataatctagctttttgactattttcgttttatcatttaacaccatatgtatagtaaggttgccattttgactgttcaatttccatgtttttatttgttcagagtatattgagtcttctatctgaatgattgtacgtaccaattgagtacccccgtgtcccaaaaatgtgtgttaatttattttatagtatacaaaattaataaactctttacaaaatagtacaaaaatagaaccctctagaagcaggagggttctaaaaaagtttcacttcactccccaaacagcctccccatcaacactcagcacactaaacgttacaacttctttctctctcgctgagtcccattctttcaggaagacaccgtcataatgtgtgccgttcaggttgattcgggctttgctgctgtcggttattgtccaggttccggtcatttccccggaaatggtgccgtcgttgttaagccggatggtttttgggggtttgatcgtagctgtaatgtcttttccgtgctggatgagtttgtaggctccggatgcggcggctgccgacatgtgtgtatccggttctcctgcgtagcggtacggcgctgcaacgggccatccgtctttgttcatgtacagccgatgcactctgacttcgtgctcttcgcctctgttcgggaaacgggtgtggaaaatgaggtatgatcgtttcgttttcccgtcgtaaaacacggagttgtgtcccggtgaaacgtagcccgtgcctttttcagattgtgaggcgaagctgtagccgcccatgagtttgaccccgtacggttcaattgctttgtcatcgaagaaactgccgtcttttcctttggcgtcaagcatgttatggcctgcggcgtcatagtacggaccgtccggatttttagagcgcgccacacgcatattgtagccgccggctgtgtcaagtccgccgaatgacagatacagatagtaatatttcgtttccggattgtagctgatgtacgggccttcgattctgctgtgatttccgccgagcagtttttttccgtagccttggttcgggagcgggaaaccggttttcggattcatttccagtataaaaatccccccggagtaagagccgtacaccatccagagcttgcctttatggtcaaaaaacgtttgcggatctacgacgttcgggtgaacgtttgcatgatacgtcgtgccgtcttcgctttttccttccatgcctgatttcaaaaagatgcctttgtttttgtagggtccttcgattttgtcactcacggcgacaccgagagcggatcgcggcgagtctcctttacaggcgttatagtacatgtaatatttcccgtcagccagctgagccacatccggcgcccacagcgtatcagactgggcccagtcgaatgtctcttttaattcggagtagacgttcgggatcaggggattattgggattgacgcttgaagacagttgctgccactgcatcaggtttttcgacttggcggaagccaaatgcgagccgaatacatagtatgtatcgcctgttttgatgacggacgggtcatgcacgctgacctctgaaaaaacgggatgctgggcttttgcctgcggcagagtgaacccgataaccgctgctgagaccaggcacacacgaaagaaactggttttcattttctgaaatctcctcgctctcttcttttcttaaaacgctttcaagacaacgctccattttatgacgcggatggcggaaatatgtgatcaacagcgccggcttcccgatgtaccgctttaatacaatagcaatctgatttgtgaaagactggaaaaaaagttttgatttctgattcgcaaacacttaatataaaaaacagttactagttatcagaatatttaagaattgagtgaagcatatatgaccttacacaaagaccgccgcatcgggcgattgtccgtccttcttctgcttcatgagactgaagaaaaccagcagatcagccggctggaacgggacggctggaaagtctgtctcggcagggtgggttcaatggatgcgcataaggtggtagctgcaattgaaaccgcttccaaaaagagcggcgtcattcaatctgagggttatcgcgaatcacatgcgctgtatcatgccacaatggaagctttgcacggagtgacgcggggcgaaatgctgcttggctcgctgcttcgtaccgtgggcctgaagtttgccgtcttgcggggaaatccgtatgaaagcgaggcggaaggcgattggatcgccgtttccctttacggcacgatcggagctccgattaaggggcttgagcacgaaacattcggagtcggaattaatcacatatgaatcagcccatagatttcagatgatagggggctatgcgtgaaatatcattttcatggcatagctcctttttgtatgggcgctttaccaaagtaaagaaaaaggggttgaaatgatggtaacgttagacggttcctcactgacaaccgcagatgcccagcgtgtgctgtttgattttgaagaggttcaagcatctgccgaaagcatggaacgtgtgaaaaaaagcagggcggcggttgaacgaatcgttcaagaagagaagaccatttacgggattacgacggggttcggcaagttcagcgatgtgctgattcaaaaagaagacgccgcggatctgcagctgaatctgattctttctcacgcgtgcggcgtcggtgatccgtttccggaatctgtatcgcgggccatgctgcttttgcgcgccaatgccctgctgaaaggcttttccggcgtacggactgagctgattgatcaactgctcgcgtttctcaatcatcgcattcacccggtcatcccgcagcaagggtcactgggggcgagcggagatttggcgccgctttctcatctcgcactggcgcttatcgggcaaggcgaagtcttttacgaaggggcccggatgccggcagctcatgctttggaaaagacaaaccttcagccggccgtcctgacctctaaagaagggctcgcgctgatcaacggaacgcaggccatgaccgcgatggggctgatcgcttatctcgaggccgaaaagctggcctatcagtcggaacggatcgcgagcttaacgatcgaaggccttcagggcattatcgatgcgttcgacgaggacattcatgccgcccgcggatatcaggaacagatggatgtcgcagagcgaatccgctattacttgtcagacagcaagctgacgaccgtccaaggggagctgcgtgtccaggacgcctattcgatccgctgtatccctcaagtccacggcgcatcatggcagacattagcgtatgtaaaagaaaaattagaaattgagatgaatgccgcgacagataacccgctcattttcgaagacggcgccaaaatcatctcaggcggaaactttcacggacagccgatcgcctttgccatggattttctcaaagtggcggcggccgagcttgcgaatatttctgaacgccgtattgaacggcttgtgaatccgcagctgaatgacctgccgccctttctgagccctcagcccggcttacaatccggagcgatgatcatgcaatatgcggcggcctccctcgtgtcagaaaataaaaccctggcccatcccgccagtgtcgattccattccttcatcggcaaaccaggaggatcacgtcagcatgggaaccatcgcctcaaggcacgcctaccagatcatcgcgaatacgagacgggtgcttgccgttgaagccatttgcgcgctgcaggccgtggaataccggggtgcggaacattgcgcctcgtacacaaaacagctctatctcgaaatgagaaacatcgtgccgtccatacaagaagaccgcgtgttttcttatgacatcgaacatctgagtgactggctgaagaaggagtcttttctgccgaatgagcatcaccaaaaactgatgaccaatgaagggggacttacaagatgactgatgtaaagaaatcaatccgcgccggccgcggcaccgaacttgaatgcttaggatgggagcaggaagccgtgctccgcatgctccgaaacaaccttgacccggaggttgccgaaaagccggaggatctgatcgtatacggcggcataggcaaggccgcgcgaaactgggatgcttttcacgcgattgagcgctccctcaaaacgttaaaagatgatgaaacactgctgatccaatccggaaaaccggtcggactgttccgcacgcacagccgcgcgccccgcgtcctgctggctaattcggtcctcgtgccgaaatgggcggattgggagcatttccatgaccttgagaaaaaaggactgatgatgtacgggcaaatgaccgccggcagctggatttatatcggttcacaaggtattttgcaaggcacctatgaaacctttgcggagcttgcgagacagcatttcggcggcagtctgaaaggaacccttacgctgacggccggacttggcggaatgggaggcgcccagccgctgtccgtcacgatgaatgatggcgtcgtcatcgccgttgaagcggatgaaacacggattgataaacggatagaaacaaactattgcgaccggaaaaccgcatcaattgacgaagcgctgcgctgggccgaaacagccagacaagccggagaacctttatcgatcggccttctcggcaatgcggcagaggtgcatcatgagcttttgaaccgcggcgtccatattgacatcgtgaccgatcagacttccgctcacgacccgctgatcggctatattccggcaggatactcacttgaggaggccgaccgcctgcgccgggatcagcctgatttatacgtaaggctttccaagcagagtatgaaaaagcatgtggaagccatgctcgccttcaagaaaaaaggggctatcgtctttgattacggcaacaacatccgccaggctgccaaagatgagggtctcgccgatgcttttgattttccgggattcgttcccgcctacatccggcctttattttgtgaaggaaaagggccgttccgctgggctgcgctgtccggtgaccctgaagatatataccgcacggacgctttattaaaagagctgtttccagaaaatcaagccctccaccgctggattgacatggcgcagaaaaaagtcacgttccaaggcctgccgtcccgtatttgctggctcggctacggtgaacgggaaaagatggggctcgccatcaatgaattggtcagaaacggcgagctgagagccccgatcgtcatcggaagagaccatttagactgcggatctgtcgcctctccgaatcgggaaacagaagcgatgaaagacggaagcgacgcggtcggcgattgggcggtgctgaacgcgctgatcaacacggcatcaggtgcaagctgggtttcttttcaccacggcggaggcgtcggcatggggtattcccttcacgcgggaatggtcgcggtcgctgacggcagcatccttgcggaacaacggctttcccgcgttctgacaagcgatccgggtatgggcatcatccgccatgcggacgcgggttatgaaaaagcggttcaagtcgccgaggaacaagacattatgataccgatgaaaaaggagcagtaacatgccgaaacaaatagataccatactcaccaacatcggccagctgctgacgatggaatccggcggcccccgatccggcggaagcatgcaggatcttcatgtcacggaaaatgccgtcatcggcgttcacgacgggcgcattgtttttgccggacatcaaggagcggagaaaggatacgaggcaagagacattatcgactgcgggggacggctcgtcacccccggcctcgtcgatccccatacccatcttgtattcggagggtcccgcgaaaaagaactgaatttaaaaattcagggcatgtcttatttggatattctggcgcaaggcggcggtattttgtcaacggtcaaagacacgaaagccgcctccgaagaagaactgattgaaaaagggctttttcacctcggacgcatgctgtcatacggcatcacgaccgcggaagtaaaaagcgggtacggactcgacaaagacacggagctgaaacagctgaccgcggcgaaaaaactgggtgagcgccagccggtcgaccttgtcacaacctttatgggagcacacgccattccgcctgagtaccggaacagccctgacgaatttctgaatcgcatgctgcagcttttgcctgacataaaagaaaaaggccttgcgcaatttgccgatattttcacagaaacaggcgtctttaccgtcagccagtcacgggactacctgaaaaaggcggctgaagctggtttcggcctgaaaatccatgctgatgagattgacccgctcggcggcgcggaattggcggcagagctgcatgctgtttctgccgatcatttggtgggggcatctgatgcaggcatcgaaaagctggcggagtccggaacgatcgccgtcctgctgccgggcacgactttctatctcggaaaacacacttatgcgagagctcgggagatgattgatgcgggcgtacgggtcagtttggcgactgacttcaacccgggcagctcaccgacggaaaatctccagctcattatgtcgattgccgcgcttcatttaaaaatgaccgcagaagaaatctggcacgctgtcaccgttaacgctgcgtatgcgatcggaaaaggcgaagaggccggacaaatcaaagccggacgggcggctgacattgtcatttgggaagcgccgaattacatgtatatcccgtatcattacggcgtcaatcatgcccgccgtgtcatcaagaacgggaagacggtcgtttcaagggagggagccgctcttggataagtattcgtttctgcaaaaagccggctccctcttcaacgaccgccatgtgacaaggatcggcgatgtaacggaagcgtgggcgggacaaacgatcaaagggccggctttgatcggcgttccgctttctaagtcgtcaatcagccattccggcgcctgctttgcccccggtgcgatccgccgggcgctcggcggcatttccgcatattctgcggagctgcgggagcatgtcattgaccatctgtacgatatcggcgatattcagattcacgtcacggatgtcgtcaaatctcatgaacacatttatcggaccatttatgatattctgacggaccagcctgactgggtgcccgtcattctcggcggcgacaactccatcagttattccaccattaaagccattgcggaaacgaaaggaacaacggccgtctttcaattcgacgcccaccacgacgtccgcaacacagaagacggagggccgacaaacggcacgccattccgccgtctgttagatgaaaatatcataagcggacaaaacctgattcagcttggaatcagggagttcagcaacagcttggcatatgaacaatatgtaaaagagcgtcaggcagacgtgcatacaatggagatgatccgggagaaagggcttctccgaacgatacaagacactttgccggccgttcaaaaaagagccgacgccatttttatttcggttgatatggatgtgctggatcaagctcatgcgcccggctgtcctgcgatcggccccggaggcctgtataccgaggaactgcttcaggcggtccggtttttagcccaggaggctgacatctcgggtattgagatcgttgaggttgatccgacacttgattttcgcgatatgacaagccgggcagccgcacacgtcattttacatgcattgaagggatttaaattgtcacgttaaagtcaaatccggcacgcgtgatctcggctgccggaagattctcatgccacgcaaaaagggggagatcacgatggatgttgatcaaggcggcaatcaactaaagcgcacgatgaaaagcaggcacttatttatgatttcattgggaggggtcatcggcacggggctgtttttgagcacagggtatacattgagccaggccgggccgggcgggacaatcgccgcttacctgatcggcggcttgatgatgtatcttgtcatgcagtgtctcggagaattgtcagtagccatgcctgtgaccggttcatttcaaacgtatgcgacaacgtttatcgggccgtccacgggttttatggtcggtatcatgtattgggtgaattgggtggtgacggtaggatcggagtttacagcttccggtatcctcatgcagcgctggtttccccacagcagcgtctggatgtggagcgcgattttcgcggctctcctttttgccgccaatgcattctccgttaaattgtttgcagaaacagagttttggttttccagcgtcaaaatcgtcaccatccttttatttatcatcttaggcggcgccgcgatgttcggtttgatttcattgcacggttcgggtgaagctccgatgctgtcgaatttcacctcacacggcggactgtttccgaacggctttcttgcggttttcatcgcaatgatttccgtaagcttcgccttttcagggacggagctgatcggaattacagcgggtgaaaccgccaatccggcaaaagatattccgcgttcgatccgaaatgtcgcctggagaacggtcatcttttttatcggcgccatttttgtgctgtccggactgatctcctggaaggaagccggtgtgattgaaagtccgtttgtcgcggtcttttcccagatcggtatcccatacgccgcagatatcatgaacttcgtgattttaacggctttgctttcggtcgccaactccggactgtatgcttccacccggatgctgtggtctcttgcgaatgaaaacatgatcagcgcccggttcaaaaaagtcacgccgaaaggcattccgctgaatgctctgctcgccagcatggccgtttcctgcatatccttgatctcaagcatcgccgccccgggcacggtctacgtggtgctcgtggcaatagccggatttgccggcgtcgtggtgtggatgagcatcgccctgtctcagctgttatttcgaaaacattatgtgaaaaacggcggacgcgtcgcggatctgaccttccgcacgccgttataccctctcgttccgatcgccgctgtgatcttatgtttcgcttcatgcgtaggccttgcatttgatcccaatcaaagaatcgccctcttctgcggaattccttgtatgatcctgtgctatctcattcgttttttgagaaagaaacagccgaaacaatccgtccgtgacattcatttggataaaaccatgccataaaaaaaggcacatactgatgaggtatgtgccttttttgtcttattccgtaatcagcgtatgaatcagtttcggcgcttccgctttttctgagatgcggatgttgtcatagactttggcggtcacgtcgtcaacgttttcgcggttggcgtaaagggtgacgagcggctcgcctttttcgacgttgtcaccgacttttttgcggagcataataccgacggcaaggtcgatttcgtcctcttttgtcgcacgtcccgcgcctaacagcatcgctgcgacgccgatttcgtcagcgacgatttctgaaacgacacccgcttcttttgccggaacgtcaattttgtacgccgcctgcggaagtttggacggatcgtcaacgacagaagcgtctcctccctgattgctcaggaactctttgaacttttcaagcgctttgccgtttttcatgacttcctgaagcttcgttctcgcttcttccaatgtctcagcttttttcgccaatacgaccatttggctgccgagcgtgaggacgagttcgtttaagtcttcagggccttcccctcttaacgtatcaatggcttcttgcacttccagagcattcccgatcgcaaaaccgagcggctgcgacatgtcagaaatcacggccatcgtctggcggccgacgttgtttccgatgcggaccattgctttggcgaggttcacggcgtcttcatccgttttcataaacgcgccggctcccgttttgacgtcaagcacgatggcatctgctccggcggcgatttttttactcataattgagcttgcgatcagcgggatggagttcaccgtacccgttacatcacgcagcgcatacagctttttatcggcaggcgtcaaattgccgctttgtccgatgacggctaccttgtcgcggttcacaagcttgatgaattcatcttttgacaattccacgtggaagccttcgatcgcttccagcttatcaatggttccccccgtatggccaagaccgcggccggacattttagcgacgggaacgccgagcgccgcgacgagcggtgcgagtacgagagttgtcgtgtcgccgaccccgcccgtagagtgcttgtcgaccttaatgccttcaatggcggagagatcaatcgtttcccctgaattgaccatcgccattgtcagatcggcgcgctcctgatccgtcatatcctgaaagtaaatcgccatagccagtgcgcttgcctgataatcagggatgcttccgtccgtgtatccttttacgaaaaattgaatttcttctgttgtcagttcttttccattttgtttttttacaataagatctaccattctcatgatctatcacctgtccttcatttatgttcagtgaatcaatccgacgatcgccgctgtcaggaagctgacgagcgttgcgccgtacagcagcttcagcccgaaccgcgcgacgacgtttccttgtttttcatgcagccctttcaccgcaccggtaatgattccgatagaggagaaattcgcgaatgagacaaggaatacagataccactgcctgtgtatgcgcgctgaaatggaaatcgccggatgagagcgtctgcatcgccacaaattcattcgataccattttcgtcgccataatgcttccggcgctcaccgcttcatcccacggaataccggttaaaaacgcaaacggcgcgaatacatatccgagcagcgcctggaatgtaatgccgaagaccgcgttaaaaacgccgttgaccagggcaatgagtgcgacaaatccgatcagcatcgccgctacgacgacggcgactctgaatccatccattatatactcaccgagcacttcaaaaaaggattgcttttcttcttcaggaacgacgatcaaatcctcttctttgctgacggtgtacgggttgatgatagaagcgatgataaatccgccgaataagttcagcacaagcgccgtcacgacgtattcaggcttcagcatcatcatgtaagaaccgacgatcgacattgagaccgtcgacattgcggacgcgcaaagcgtgtataagcgctgttcagtaagatagccgagctgttttttcaaactgataaagacttctgattgccctaaaatcgcggatgcgacagcgttgtaagattcgattttccccattccgttcaccttgcttaacgcaagaccgatatacttcgtgatgaagggaaggaccttccaatgctgcagaattccgattaaagcggatataaagacgatcggcagaagcacgctcatgaagaacgtcgtctgtttcgcattcacaagcccgccgaatacaaagttaatcccttctgatgcatattccagcaagtagttaaatccttttgcaaaaccgccgacaagaaaattcccgataccggtgttgaggagaatataaccgagaatcagctgcagcacgagcatgacggcgatcggccggattctgattctttttttgccgttgctggcaagccaggcaagacctaaaaacacaatgattccgataattccgatgagatacttcatatgtgttctccttttatttgtattcgcttacaattttttatgcatcaacaaagaaagaggatggcggaagctttcggcttccgcaatgctgattaatagtcgctgctgccgctgtctccgccgctcacgatagagacgcccgcacttgcgccgatccggctcgcgcccgcagcgatcatgctgtcaacatcagcttttgttctgatgccgcctgatgctttgaccccgatgtccggtccgactgtttttctcatgagagcgatatcttcagccgttgccccgcctgtagaaaaaccggtagacgttttgacgaaatcggcgcctgcggataccgccaagcggcatgcacgctctttttcttcatctgtcaaaaggcatgtttcgatgatcactttgacgagcgcttttttatcagctgcttcaactaccgcgcggatatcagcttcaaccgcttcatcatcgccgtcttttaatgcgccgatattgatgaccatgtcaacctcagtggctccttttgagatggcatccttcgtttcaaatgcttttgtttccgatgtcgttgcgccgagaggaaatccgataacggtgcaaacgtcaactcccgtgcctttcagttcctccgctgcgagtttgacccaagtcgggttcacacaaacggaagcgaatttatattcttttgcttcttttatcagttgtaaaatatccgctttttgtgtatgcggtttcaaagcagtatggtctatttgacttgcaattgacattgtatgcacttcctttttcctaggatacgtttagaataaccgaattttgaacatatgtaaattggtaattgaaattatgttcatgaattgtcacaattcttgaatgagttttttggccgtatgctgatcagtaatcaaaacgttggcgtactttcctttcaaggcaccgtgaatggccttgcattttctgctgccgcccgccaccagaatcgaacgctctttcaatttcaggtcgctgagctcaactccgatcgtcctgccgttaatgctgctgctgcaaatcctgccttcctcgtcaaaaaagcgcgaacaaatatcgccgactccgcgtgctttcagcaattgtttctcttcttcccggaaatagccgagtctgaaaagcagcgcctcatcccggacggttccgaccgtaaacagggcgatattagcttgtctgcccatttcaatgatccgcttaatatgtctgtcccgctcgaccatctgtttcacatcggcgctgtcaaatataaccggcagcggcaaatacctcggcatggtctgaaatgcttcggcgaacagctgaatcgtttctgacgaatacgtattgacattggaatgactgatgccgcctttcagctgcacgacttcaacgctctttacctgcttcggctccatgcggcttgcgatctggtacatcgtcgtcccccagcttacgccgagtatatcgccgtcctttacggttttatgcatatagtctgcgccatagcggcttaagtaatgtgtaatggcctggtaatcgtcgcttggagaaaaaacgacgtgcgcctcaagcagcccgtatttttcttccagcttcgcgctgagttcgtccagatcctcaaacgggtccatgacgcgaatttgcacataccctttttcctttgcgtactgaagcagccttgaaacggtggggcgtgacagattaagccgttcggcgatctgctgctggctgtaatctgattgataatatagttttgccgcttctatgctgagctgctgtttttcacgatccatgtcgcgcctcccctctccgcttatcatatcaccaaaacacgcggtaaaaaagcaccctctgatggggtgcctattttttcagcacaagctcctgaatcgcatgcgccacgccgtgttcgttatttgatttcgtttcataatcagcaatctcccttacttccgggatggcattggccattgccacaccgcagccggcccactgaatcatggacatgtcgttgccgttatcgccgattgccatgacgtctttctgttcaatgccgagtttttcggccagcagcttgaccgcgtttcctttactgactttcgggtgaagaatctcatggaagaatggcgcgcttttgaccattgtgtatgtttccctgaatgattccggaatagaagcgatcgctttctccagcttgtccggatcgtcaatgaacatgactttcggaatcagaatatccttcggcacttcatcgatcgtgcggaaatgaagcggcactttcgtaatgtatgattcgtataccgtgtattcactgatatcccggttcggcgtgtacagattggctgtgtcaaagtaatgcatcggagtatccaactgtaagctcagctcgtaaagcgactccaaatcttcaaagcctaatgactgctcggccacgacaccgtttgtatacgtattttggacgagtgcgccgttataggcaatcacaaagtctccttcttcctgtaagttcagctcttccaaataccgacgcacgccgccgatcggccggcccgtgcacaggacgatattgaccccttccgctttggcggcatcaagcgccccgcggacttcagccgtcacttcatgatgatcgtttaatagtgttccgtccatatctattgcgattaacttgtacatcctgcatctcctttgtatccttttctgcttatgctttcatcatatcgttttttcgtttcaatgaaaaatcaaacggacaagtttctccgccttctcttcctataccgggcctgcctccggatgcggggccgtcttttccccttgtcagcttgttcgccgctgtcatctgttttctgcttcaagagcatcagccccgccgcaaagaaagggacggccgctatgtccagaagggcaagctttattcccatcgctgcgggaaagtatgcccataatgaacggctgttccgcctgatcatgatataagaaacgatttccagcaggataaacagagcgttcacccacaagtaaatgagcatcgccgcaaacagaaacagcaggagcgtattccgcagcgtgccggaaaacagaagagcgcgcatcatatcaaagaatgaaaaagactgcatgctgccgttgacgacattgggattataaatggtaaaacgcccgaactgctctacaagcataaaaaataaccacaacagtgaaaaccattgaatgatatgtacgatgacacccgtcaaaacgagtctgtcggcagccttatttctcatgtgcatcctccccgccgatttttattcttgtcattgtttttgtttctccgtatatcttccaaatgagcgtatcgttttttcctcttttcaacgtgcttttgacggggtgcggatgtccgaggtattcaatctcgatcgttccgtccgtgttttgtgagaccaccttgtaaacatctgagggcatgggaacctcgccgcggcctttaatgacctgctttgtcagcacgctgtctttcgtaaacgtgacggtttcagatctgaccccgtccatagggcccggtttcagccccgcatcccatgtcccgtaataaaaagggggttcgtctgctttcttttgcgagcagcctgttatcatgacgcatccgataacaagaaccgtcatgatgaaaatccgtatgttccgcaacatgatcaccttcctttgaagctctttttacgcctgtaagttaggcggatgccgtggcactgtgcaattgactacatagtgtataaagacttcactagataaggagaatgatgaatgaacccatatcagtactacaccccatctgcctatttccctcagcagcaggaatacgaagtgagccccgttgagtatgagccgtatcagcagcaggaaagctattattatgcgccccctcagtctgaagagcggcagccgacggctttagaacggagagttgcccagcttgaaagacaaaacgcccagcaaacgagagagctcacccgcctctcacaagaagaccagcgccaaaaccgggaaatcacgcgtatgaatgagcagatcagacggctgagccagtccattgaaatccatacccgccgcttaaaccgtttgaatcagcgcctgcgcgcagtcgaaaacagactcaatattccttttcacgctacagaaggcggcttctgagaaaaagggccggaatacaaagctcgacaggccatcccgagccttgtattccgctctgtacataacaggtaaatatttgaatccttttcttgcatgaatgcctctcctattctttcacatgataaatgtgtaaaatcaatcacttcaggaggtcttcatgatgtatcaaaaccaatacagcggaaatcagctgcagcaatgccgtcaaacagcacagcagcttattcagcagacacagcaaagcagtcagcagtacaagcaaatgctccagcaggaacagcaaaacattcaaatgcttcagcagattcttaaccatgaacagcatgccgttcataccattcagcaagcgctgcaggggcatgaactggccattcagaaatgccagcaaatcgtgaatgtgtgcaatcagcttcagcaggaagtaagcggacacatgcctgcaccgatggcaaacgctaatgtttcttcattcccgcaaacacagcatcacacaccgtttcagcagcattcataccagcaataggccggtcatgcaaatgacaaagcgcgagataccggctttgtcatttgtttttatctctgttttgtcagatcaatgcgttgagcgggttttccgccgaatttttcctccgcctcatgccttaccgcttcaaacgctcttgcttcgacgttttgtttaaacacatcaagctgtattaaataagccgcccgcactttcagcccgtggatgatggagatgacccataaaggcagcacgatatacacgcccggcgtgctcggcagcacaaaagcaattgctaaaataataaaatagataagtccgtatttcagccattttttgttcttggcccggtagccgatatagaaaaaggccaagaaagcggtcagcccaaacggcgcgaaagtcagcagcagccaccagctgtgcagcacttcccaccaagtccctcttttcgtaatcaacattcattcctcctcctttactactataacatggataatcaaggaaggttttctataaaaaacatagacggaatgacgtcttcctgctatattaataatgataatcattatcaccgaaatagggggatcattatgaagaaacaatcatggctgatcggcctggcacttctgcttgttttcgcattaagcgcttgcagcggcgcgaaggaaaacaacggatcggcatcaggcaaaggaaagacagacatgcgtacatatgaatcaacaaaaggaaatattgacatacccgcacatccgaaacggatcgtcactgacttttatgcgggtgagctgctgtccgttgacgcaaatgtcgtcggggcgggctcatgggctttcaaaaatccgtttatcaaaaaacagctgaaaaacaccacggacatcggcaatcccgtcaatgtggagaaagtgatgcagctgaagcctgatttaatcgtgctgatgaaggatgaccaatacgagaaactatcgaaaatcgcaccgacgattgtcattccttttaacaccgcaaagaatacgaaagatacggtcagcctattcggtgacattgccggggcgaaggataaagccaaaagctttatggcagacttcaacaaaaaggcagaagccgatcaaaagcgcctcaaaaacgtgatcggcaaagacaagacagtcggcctttatgaaacgacggataaaggcgaaatctggattttcaatgacaattccggccgcggcggccaagccgtttataacgcgctcggattgaaagcgccggccaaaatcgaaaaagacatcatgaaaacgggcgccatgaaacaggtttcccaagaggtcatccctcaatatgcggctgattatatgttcattaccgattacaatccgaatggagaaagcaaaacatttgagcgtctgaaagagtcatccgtttggaaaaatctcgatgccgtaaagaacaaccgtgtctttatcaacgatttcaacaccttctatccgtatgacccgattgccgtcagcaaacagatggatatcatcaccgacatgctgatcaaacgggctgaagaaaataaaaaataaaaaaagcggcacagtcatgacactgtgccgtttttcatgttcactttaattttgactgtacggatcccggcatatcttcaaatctgacttcttcccaggtctcgacatactttcctttcgccttcaccttcaaatacgcgttcttccgaaggtctttcccggcgaaaaaggtcacttcttcttttttcccggatgcgttatatccgtctaatgtatactcagtaccgcccgggctaagatgtttgccatctcgatcaatctgtacataaacatcttgctggtgaataaacggattaaatctgtctgtaacatcattatgaaaaaagagaagtccgtatatgacggcagcggccgccaaaacggccaggattgccaatgcttttttcatctgtgcactccccttacttgttcatttttttcaaatagcttgtccgcaccgcgaggaagaacagaagctgaaagatgaaaaaccctccgatggtcagactgagcggccccgctacatcggaatagccttccaccgctaatgttctcaaagcaaacagcgtatgcatgacggcaatgacgaaaggaaagaaaaagagaatcgccaattgtatcgtcacgctttgtgccatttcacgctcgctcagaccgattttggccaatgagcggtagcgctcccggtcctcatctaaatcggtgaacagcctgaaatataagaaactcgctgccgcgacaaagaaaacgatcgcgataaacaggccgatgaataaactcaggctcggcagctgcaccgtatcatagtacgtcccggcttttgccataaaatcagaatgcacgtcgatatagttgccgtaaatctcatttttcaaggattggctgatcccaagactgtctttccaatgatcatagctgtagccgtataatgacgctttctcaccgagtgatttcagctgatcaaaggtttgatcgttcaccgcgatgatggcattcaatgaaatcagcggttttttgacttcttttaccgtcagtttttggtcagacggctttgctttttggttcagcagtttcagctgatccggcgcgtcgtttttgaaattgcggtcatacgtgcccgggaaatagacagcctcattatgtttcagcccgttcagcttgacatggaagtatgttgacacatccgattcgctgatcatgtaaacaggcggaacagtatctccttcctgatagcggacataggaaacatttattttgtctttcttatacgtaaagccgtgtgttttcagttcatggtcaatatctttcaaatgagtctgttctttcgggttattgctgaaagataaatactccatctcataggcggactcttccgccccgacggtcgatttgtacatcgcgagcacgcccgtcgccgtaaaggcaaccgcggaaataatactgacgataaagaacaggcgggcattgtcttttaaacgatagacaaggtcagaaacccaaataacatttttcccgcgcagataaaaggttttccacttcttcagcgcgcgcagaatccagatgctgctttggctgaaaaagaaatacgtgccgatgacggtaagcagtaaaatgatgaacggctcggtcccgtggacattgcctttcagaaccatgccgtacccgccgcacaggcaggcgatgccgaataaggacagaagcacggacggcttcggctccggcttgatcttgtcagtgccctttattaatttgatcaccgtatttgatctgacaaaaaggatcgtgaactgcgataaaaggaaaaataagagcagaaatccgccggccgtaatgccgagcgctttccaaggcatgtacagaggcagcgcgtccatttctaaaatataagcgccgaccgtaaagaacgttttcgaaaaaatgaagcctccgataatccccgctgcgatcgacatgacgccgatgatcatgttttccgccgtaatgagctttctcagctgcaccggcgtaataccctgcatcagcagaataccgaattctttatttctcgatttcaaaaatgcgttaaccgaatacagaacaaataagaaagaaaaaacaaagatcatccattccgcggcggttaagccttttttggcgatgttattcaggtagccttcctttagtgccggatgaaacaggaacatcgcaaaggtaaagaaaatcaaaacggaaaaggcgctgctcaagaagaatgcaagataggcccttttgtttctcgtgacgtttttataagcgaactgaagaaaggtcatttgcgtttccccccagcatagacagcacatcaagaatctgctcataaaagacttggcggttttccccgcggtaaatctcattaaacagttcgccgtcttttataaagatgacgcggcggcagtagcttgccgcaaccggatcgtgggtcaccatcaaagccgtgacatgatcatcctgattcaggctctgcatcgtttccatgacatcttttgacgctttggaatcaaggtttcccgtcggttcatcggccagaataagtgacggcttatgaatgaccgctcttgcgatggcggcccgctggcgctgtccgccggatacttcaaacgtccgtttattgagcagatcttcgattccgagctttttcgcgatgccgtgcagtttttcttccatgacagacggcgcttctttttcaagcgttaacggcagcatgatattttcaccgattgtcagcgtgtccagaagattgaaatcctgaaacacaaatccgagctgcttgcggcggaaatgagcgagctttgtccgcttcagccggtgcgggttttctccgtgaatcaggatatcgcctgaatccggccggtcgatcgttgaaatgatattcaaaagtgttgtttttccggagccggacggtcccatcaccgccgtgaacccgccttcttctattgaaaatgaaatttgttttaaagcttgataggatacttgtcctttataggttttatttatatgtttgacttcaagcatattcgccatgagaatcctccttatggttttattcttgttgatctgggctgctttcatgtagtgccggggcattcagcataaaaaatccccttgacgtaaatccatgttatcaaggggaaacagaatgagctatgttgttttcttaacgcagtcttacatttttgtaagaaatgaaaatcggaccgatgtcccttcaccgggggacgagctgatgtccaccgtatgattgagcttgcccgtaatttctttgacgagatggaggccgattcccgtagattcttggaaacgccgcccgttttcgccggtgtaataagggtcaaacacccgcttgatatcttgcgagggaatgccgacaccgtaatctttgacttcaagcaccgtcctgtcttcatcgcagaagacattcagctccagtctgtcactcttgcccgctgaatacttgaccgcatttgtgaccacttggccgatcgcaaatttgagccatttggcatcggtgtaaatctgatgatcatcgcgaatatccattttcggatagacgcggtactgaataaaaaatcgtttatagctttgaatgaccgattggagaagctctgataaggaaaccgcttcgactttaaaatcccgctcaaacaggtcaagccttgatgaataaaggagcgtctccagcccgaattcaatctgccggacctcttttttgatttgttcaaagacgggctcatcctcttcctgaatgattaaattaatgaccgacagcggcgtttttacttggtgcacccattgattcatatacgtcacccgcgcgtcgagcttggcttcggtctcgtagagcttctggtgctgcagccgggtcagctccatctgcttttcatacagctctgaacagaacactgaagaaccgagatacgggatgtccgtcccttcctgctccgagctgagccaatgatacacaccgcggtctttgtaccagcgataggcaagataccccgccaaaataagaagctgcacgcccaatatgtaaaacaggtgggaaaaagaatgaagacccgcaaaccagtaataaaagaagacaaacagcccttgaaggagaaaaagcagaatcagcacggcatgagaccggagaaacagcttcatgacagcgccctcagctggtagccttcgccccgcaccgattcaatggaaacaggcgcgttcagctcccgcagtttttttctgagccgcgtgatatacacgttaagcgtattatcatcgacgaaaatgtcggtgtcccacgttttttccatgagccggtctcttcccgtcaccttttctccccgctccagcagcacttccaaaagcttgctttcttttttagaaagctcgcttttttcgtcctgaaagcgcagttcaaaccgttccacaaagagctgcacaccggcatattcaaccactttctcaccctgcttggcggcgtactctccgtatgccctgcggatctggcttttgattttcgccagcacaatatcataagaaaacggtttttcgatataatcatctccgccgttttcaatcgccatcacctgatccatttccccgcttctggctgagatgaaaatgatcgggcttgtagaatgctggcggatctggcggcaccaataatagccgtcataagacggcaggttgatatcaagcagcaccacatcaggcttttcccgcaaaaagacatcaagaacagccgtgaaatctgcggcggccacggtttgatatccgtatttttcaaggtaattctgcaatagtccgcgaatgtcttcactatcttccacaatcatgattttattcaaactgaaccactcccgtttcttacactgctgccatcatcataatcgtttcgggcgtacggacgcaacaccgcacaaaaaaaccgccatcttggcggtttccgttttcatcagccgacctgctgttttacggctttaccggctgatccgaactctctcattttgcttcgcaccgtctcttccacggcttcaaggccgggtgtcatgtagccgcgcggttcgtacagatcgccgttttcctgaaacatgcggcgtgtttcgtctgtccaggctaccatacattccgtgttgatattgattttcgcgtggccgagcgtgatggcttttttgatctgatcctgaggaatcccggatgctccgtggagaacgaggggaatatcagtcatgcgggagatagccgccatttctttaaatccgagattcggctcgccctgatatttgccgtggacggagccgagggcggccgccagcgcgtcgatattggtttctttcacgatccgttcacattccatgatatcggcataacagaccccgccgacaagtccgtcttccatgccgccgaccgtgccgacttcggcttctactgagacgccgtgctttgcggcataatcggtgacttcttttgtcatcgcgatattctcgtcaatcggctgatgggagccgtcgatcatcaccgagctgaatccggcgtcaatggcctgtctgcagcgttccgcactgcttccgtgatcaagatggagcacgacgggaacggtaatcgccatttcttccattaacgcgccgaccatggcggaaatcgttttaaatccgcctaaatagccgaccagacgatcggaagccgcggcgatgaccggcgattgctccttttgcgccgcttgcagaatcgccttcgtccattggaggccgttgatattaaattggccgactgcataatgctcccgtttcgcttctgcaagaagatgtttcatggtgacaaaagccatgttcacgcctccttcatgaagtattttgatacgacggcttccgttgtttcctttgccgttttgatcgtttcctccgcagtcagcttataatattcaggtctgaacagctctacggagacaacatcattgaatccgatttcttttaacgctgacagatgggcgtctaagtcaatcgcaccctgcccaggccagacgcggtcttcatccgttaaaaagccgatcggaaagtcttctgtatcgtcgatatgatagatgaaaattttctttccgtccgcctgcttcaagctctcaatattggagcccatcgcgtggaaatggaagctgtcaaacaccagtccgacattatcgcggccgacagcgttcacgatgtcatacgcctgttcaaatgtattgaccgtgcattgcgggtggccgacaaattcaagggcaatgtttacgccgtacggctccgcgatgtccgaaagctcagtcagcacctctatgctgctctttttgatttcttctttcaagattttccgctctgtcacaagcggcacggccaccacatatttcacgccgagcgtcctgcaggtttccatcatttttttgaattccgaaatgatctccctataacccttctcatcacgattgttgaagaaaaccagggcgttcagggcaagcggtttaatgtgatgggtttgaaaatattccgccagatcggccagtgaatggtcttttaagtattccggcagcttatccattgtgcggatttcgatataatcatagccgtgcttttcgcacagttctaaatcctgtttcaggtttgaattctccagcgtagtcgcttcattaaagcaaagtttcatgtcagcctctcccttccgcgttttcgatatgaagggagtccggctgaagggcttttttgccccgatccgccgaactccatactcagcttatgccatacccagttcttcctttaatttcttaagcgtggtccggcttgattcatccgctctttcgccgacccaagcaaacacggcgttcgtcgcaattccgtcgaatttcatctctctcatctttctgaaaatcgtctcaaaatcgacctcgccttgcccgatgtccagatgctggtgaaccgttactttcgcatcaggcggattgacgatgtaacgcaggccgtgcgccgctttatgattaaaagtatctgcaaataaaacatgtgtgaggcggtcgccggcttcatcaaacatggtttcgatatcgcctttgccgtcatcatagaagaacgtatgcgcagtcgagtagacaagattgatccaatccttatcgagcgcgcggatcatatccatcgcacctttgtgcgtttcgataaaatcgtatggatgggcttgaagattgagtttaacgccttctttttcaaagacgggcagcagctcatccatggatttgatgaatttttcttcacttgtcaacggatcatactttgaaccgctgaattcactgttcatcaaatccacttcaagttcaaccgcaatttcgatcgcccgtttccagttgcgcacggcggcctggcggcggtcttcatctggacccgcccagtggtaaagcggaagaagggaggacagcttcacacctgtatcctttaaaaggcgcttcaattgtttgatttttgctgaatcgactttcggatatttatagaaaggacaaaaatcctcgcgcggggacagttcgatatattcgtatccgagttccgccgttttatagaccatttcctctaatgttaaatcatcgcggtacatggatggatctaaggccagtttcattttttcactcccgatctattatttgttcacagtcgtaaatgattgatagaatgccggtttctcttgaagcgccactggctctttctgtccggattcctgagcttttacgcacgcgtctgttgtcaccgcggcaatataaccgtcccatgccgtcggaccgctgacttcgccttttttccggatcgaatcaatgaagtcctgaatttccacatcatacgcagccgcaaatcggcgctgccagtccatcagaatatcggtgctgaattttccttcttttctcaagctgatgcttgacggttccggaagcttaatgacgccgtcttccccgacgatctcacattgaatgtcatagccgtatttacagttcacatagatttctgcattgatgacgatgccgccttttgtttcgatgatgaccatctgcggatctttcagatgcggcagcgcattttttgatttcttcggatagatgacttgtacggattcatagtcgtcattgacaagccagtggaggacatcaatttcatgaacgagcgtatcgacgacggccatgtccgttgaataattcgatgcgactgtcgggttgcggtgcgcacagtgaatcatcagcggctcgccgaccgcacggttgtcgatcgcttctttcagctgaacgtaaccgctgtcatatctgcgcatgaaacctacctgcaccaatcgttttcccgtcttcatttcttcctcgacaatgcgcatacagccttctgccgttgtcgcaagcggcttttcacaaaacacgtgcttgccgtgctgaatcgctttcaacacgctggattcgtgagccgggccccagcttgtcactaagacggcatccacattttcagcagcgagaaggctgtcgtcatcaggataaaccgaggcgttcaaattgaaatgctgaacggtctgctgcgcggcctcctgattcacatctgtgacagcggtaatttccgcgcccgacagcttatttgtgatgcggttgatgtgctcttttccgatagcaccggttccgataacacctatacgtaaattcattgatcgccactccttctgataatcaaataatggttctcgtctttcttttctctctgccgtcctgaggagcaccgtacagttcctcctgtatctgttcaagcgacttgccggacgtattcggtgcgaagacaagcccgatgatcatactggccgtcacacatatgagcagaataccggccataaaaccgatgccgaattgtgacatgatgaccggcacaaataaactccaaatgccgattgaaatacggacgagaaagaacatgagcccttgtgctgacgctctgtgttctgtcgggaacagctcgcttgcccacagctggtagttcgcctgctggccggctccgttattgatgccgatcgctaaaacaaacaaaagcagcatcgggagtccctgaaacggcagcaaaaacagcgaccagccgacaacagccataaaggcgcagattccgaacaccgttttccgatattgatctgcaaaaggcatgaagatacaggcgacgccgagcccggtgaagataaacagggccatctgcagaatgttggccgtatttgcggatacgccgccgacctgctggtagatgtacggcatgaagaatcccatgacgcccgcggcgagattccatacgagaaacacacccattaaaaacaaaatgttcttgaaaaatttcggctgaagcaagtcaaaataagatgtttttttcacggcggcaggccgctcttcactgtttttccaggcatccgactcaggtaaacgctttcttatcacatatgtgatcagggcgatcaccaatagatgcgcaaagacaattttatttcctaaaagcccgaggtcaccgaccaaaacggataacagcagaaccacaacggctccggcggcccacgccacctgcgccactccgcaatgcctcgcccggtttttttcgggggcgttttccgcgataatggtccatgaagccgtaatatccgcgcctacagaaatcccgataatcatgtatccgcataacagcatgggaaagttgaatccaaacaaaaccaaacaaattcctaaagcgtagacgagcatactgtttgtgtatacagcttttcggccgaccttatcagccaaatacccgccgagcagcgctccgatggccgctgatatcgcgtttgcgctgaaggcgccgagcaatccgatctgactgtcggacagcttcaagtagctgacccacatagataaacccgctgatcctgccacgatggaacctgcatcaatgtaatttgctaatgctgcggcgatggtccgtttgctgaaagctgattccgccttggcactattcatataagtccccctctaatttgcaggatcaagcagttcactgtcgatgtactttctcgcaatcagcgcgtactcaagcggattggcgactgccgggtcttgttcggcttcaatgacgatccagcctgaataatcatgacggacgagcgtttggtacacttcggtaaaatcgatgcatccgtctccgggcaccgtaaaaatgccctgtaaaaacgactgcctgaatgacttgccttcctgtctgcaccgctccataatgtcaaaccgcgcgtccttgaaatgaacgtgtctgatccgatccatatgcttgttgagaatcgtcatatagtctccgtctgagatataggcatggccggtatcataaagtaaatggacataccgcgggtccgttccatccatcagccggtcaacttcttccgccgtctggacgcctgtgccgagatgatgatgaaacgtgagctccagcccgtattcgtcagcgattttcccgagacggttcaagccttggcacattgtatcccattcttcatctgagaagtgcggttttttcttaaatacatcaatatccaagccctggacactgtacgtctgttcagaaacgatggcggcatccgctccgactttctgcaaataatcacagtgttctgtaaattgttcacccgttttttcaataccgtcttgaatgataaagctgctgaaccatttccccgcaatccgcaagttccggagagccagctccttattgaggacggagggttcagggaaaaaccctcccacttccgtaccttgaaaaccggcgacaacaatatcgcttaacaaatgctgcagcgtattcccggctccgatctccggcatatcgtcattgcgccacccaatgggagcgatgccccacaaaatattttgtttgcccatcgtgatgcctcccctctagtactgcttcgcagacttcagcttcatctctttcgcttcgtatgcccgctgaacgctttcctgctcagacacttccgccacgccgacatgccaccagctgtcatagccgtccgtcatcgttttcggcagaaccttcatttcaattaaagtggatacctcttgcgttttcgcatcttcaagcgccgctttcagttcttcaaccgtattggctctgtatgttttagcgccgtagccctctgccaccttcgcgtaatcaacgtttaaaatctgattgtcctctgtgcggaactcgcagaaataactgccgctcccgtgatccatctgcaggttgttgatacagccgaacccggagttgtcaaagagcaggacattgatttttttgttatattgaagcgcggtaatcagctctgagtgcagcatcagaaagcttccgtcgccgacgagtgaatagacttctttgtcgggatgagccagcttgaggccgagcgtgcccgatacttcatatcccatgcaggaatagccgtactccagatggtacgtattcgggacgttggaatgccatagccgctgcagatcccccggaagagatcccgccgaactgatgacgacgctgtcttcaggaatcgtgtcattgatggtcaacagcgccgttgtttgcggcagctcagtctcgagcgcgtcggcatactcgtttaacacgtcctgtgagaaatggtttttaatttccggcttgaacgcgtcacgtgtaaaagtgaccttgccgagccggtcccgttcagccagccattcatctttccagtctttaatcgccgtgccgaatgcacttttatatccgtctaataagccgtgcagcctgccgagcgtcactttcgcatcggctacgacctgaaacgcgtcaagtttgtatgcctgcatgcggctgacattgatattcaaaaattttgctttgtcaaaatcaaacgccgttttcgaggatgtcgcaaagtccgtgtaccgtgtgccgacaccgatgatcagatcagcctggcgggcggctttgtttgcggcgagtgtgcccgtgatgcccatgccgcccagattgttggcaaaatcggcttcaaccgttgacttgccggcctgcgtttcgacaagcggaatgccgtatgtttcagaaagcgcgattaattcctcacgcgcgccggagtacttcgcgccgccgcccactaaaatgacgggacggctgctctccttaattctctccgcggcgcctttcagctcacgctcgctcggctgcatccgatcaatgtaatgaacacgtttttcaaagaagctttcatcaaaatcaaatgcttctccctctacatcctgagaaatgcagatggtcgccgggcccgcttttgccggatctgtcatcacttcaaatgcccggattaagctgctcatcagctgctcggggcgggtgatgcggtcccaatagcgggacacgggctttaacgcatcgtttgtcgtgacggcggcgctgtattcctgctccacctgctgaagcaccgggtcaggctgcctcgtcgcaaaggtatcggccggaagcagcagcaccgggatatgattggccagcgccgtacccgcggcagccgtcaagttagcggcacccggaccgaccgatgtcgataccgcataaatttttcttctcagcatctgcttgctgtatgccatcgcggcatgcgccatgccttgttcgtttttgccttgatagactttcaggtgcccggcgtcctgctcaagcgcctgcccgatccccaacacatttccatggccgaaaatcgtgaagatgccctcaacgaacggctcttcttttccgtcaacatgaatgtactgccggttcaagaattgaatcagcgcttgtgctgtcgttaagcgaattgtcttacccacaaacgatcccaccttttatacgttctatttaccgttaagactgtgctgcgcttcaatcagttcgatgatttcaccggcagccggcattgcttctgaggagctgtgtttgctgacgacaatggaagcggaagcgctcccgtattttaacgacgtttcaatatcccggccgctgaccagtccgtagatgaaagctgacgcataggaatcacccgctccgaaggtcttcagcacctttgttttataggcgtgcgcccggaaaacttctcccgatctgctgtatgcgtatgatccgtcaacgccgtgcttaatgacgacaaggtcggcggagtgcgcaaacaaatggcggacggtttcatcgttatttccgccgctgcggttttccattacgtcaaattcgtcacgcgtaccgatgacgatatcggattgttccgccgccagcgtgtagtagacggctgtttcttctgccgattgccatgtatacggacggtagtcgagctcaaatacgacttttacgtcatgtttttttgcgatttgcaccgcttttaagacggcttcgcgcgacgggcttttcgcaagcgccgtacctgatacgagcagcattttcgcgtttgcgatgtagccttcattgacttcggacggctctagatacaaatccgccacgtcatcccggtacatcagaatgctgcactcttcaggactgagaatttccgtaaaagcgagcccggctttgcgtccttctctgtcaacggtcatttgtgacgtatcgacgcccttttcctgcatataagaaacgataaatctgccgtgctggtcatccgggattttgccgataaaaccggcttttaatccgagcttagcgctgccgatcgcaatatttgccggggagccgccgacatatttagaaaacgtcatcgtttcttccatcggccggttgtattccgccgcgttcaaatcaatacacgcgcgtccgatcgcgacaatatcaaactctttttcttcattaaatgtatatttcatcgttatctgccactcctcacttgtcagcgttccagaatccattcatgggccggatcattatgaaacttccattttcgtgtcggtcccgccattacattcatgtagtaagaggtatacccgtccggaacaccaaccgggtgatagcccgccggcacgatgacaacgttttcattttctgcggtcatcgtctcgtcaatcgagcggtcgtccgtgtacacacgctggaagacaaatccctgcggcgggtccgtttcatggtaataggtttcttctaaaaatgattcagccggcagattgtcttggtcatgtttatgaggcgggtagctcgaccagttgccgctgtccgtgtaaacttcaacaacgagaaggctgtttgccgatggatctgaatcggggagaatgttatgaacggttcgtttgtttgccagcttgccgcgatgttccacaccgttgtcttccgctttaatcagctttgtcggaagctggtgttcggacggagagtagcacagcgcgaccctcgccccgctgacggctgtgattccaaaagagcggtcattggacacataaacgctgtccgtcggttttctatcaaatacgctttcacgggtgccgatgctttcaaatgtctgatcataatcagtgacggtaacttttccagttaccgcaacgatgcagcactccgtctttttcaaatcttctgtataggttgagccgggagcgagatcaacgactttaaatccgacgtatttgaggtctgaattggctgaagtgacgtcatgtatgatggtcacgccttgagaaatttcatcggcctgcggtttgcgcagcaaatgactcatgtttattcctccttaatggatggtaaaagaaaacccggacggaatcacaaagccgtccgggccggctgtctgatcaattgaagtcaggagacgggtatcgtgccgtcacgacttttttacgtgtatagaagtcgacgctgtcttttccgtttgcgtgcaatgtgccgaagaaagaagacttccagcccgagaacgggaagaatgccatcggcgccgggacgccaaggttgatcccgagcattcccgcgtcaatattctcacggaagtagcggatcgcgttcgcatttgacgtgaacaggcaggcgccgttcgcaaattcagactggttggcgatgtcaaccgcttcttttaaatttttcacacgcatgaccgacagaacaggcgcaaagatttcatctttccagatcgtcatatccgtcgtcacgttgtcaaaaatcgtcggtccgacgaaatagccgtcttccgttacatgttcacggccgtcacaaagcagtttcgctccttcttcgatgcctttttcaatatagctgtgcgtacggtttttgttgtcctcgcggatgaccgggcccaagaacacgccgtcatccagtccgtttccgatcttgatgtctgcggccttttcctgtaatttcgccataaactcatcggcgattccctcttcaaccgttacaaccgcgcatgccatgcagcgctctcctgccgaaccgaatgccgcgccgataatgtttgtgaccgtatcttcaaggtgggcgtcatttaacacgatcgtatggtttttcgcgcccgttaacgcctgcacgcgtttcaaatgttcgctgccttttttgaaaacatactcgccgacaggttttgaaccgacgaatgagatggctttaatctccggatgctcaagaatgccgtttacgacgtcatgcgcgccgtgcacgacattgaagacgcccttcggcagaccggcctgttcaaacagctctgccagtttttccgttaacagcggcgtgcgctcagacggcttcagaataaaagtgtttcctaatgaaatcgccatcgggaacatccagcagggaaccatcatcgggaagttgaacggtgcgataccgccgaccaccccgatcggatagcggtagttcgccgcctctacatctgtggcgatagaggcaagtgaatcgcccatcatgagtgacggcgcgcctgctgcgaattcgacgttttcaattccgcgtcccacttcaccgagtgcttctgtcgtgtttttaccgttttccaaagtgatcagacgggcaagctcttctttgttctgctggagaagctgctgatagttaaatagaattctcgcacggcgcggcactgccgtcttcgaccatgttttaaacgcttctgacgctgagcggacggcgtattccacatcctcccgcgtagaaatcggaacctggcacatcacttcttttgtagccggattgacaacgtcttcatattgatctgtcttactttcaacccattcaccattgatgtagtttttcagttttctgatctctgccattctcattgcctccttaaatagtaaacatccctgggtaataacggatgaatatattcatcttttacatataaaagacatgaattaaacgcttacaaatgctaaaatgatggtggctcccaatcttttcatgtaaaagttggtcatgtgccggataaagcaaacggttacatcttttacttttgattttacaggttatattttggtcatttcttggttacattgtaagcccaacacaccttcaagtcaatctaaaaaatcaaaattttttcattatttttatcatactttttttaagcgggaaaacaggaacttggagaaccgtgtcgaatcgtacggtgggaaccctcttttttatcatttgttaagtaactattgattaactcttggtgtttattatatattttaattactttaagaattctagaaggagtttttttatgaaactgatgcggattcaggagatggaagaatacattctcaaacacggagccacttcgctggatgagctgtgcgaggtattcaacgtctctaaaaacacggtcagacgcgatattaataagcttgcggaaaaaggggtgatcaaaaaggtgtacggcggcgtgacgtcagcagaaaaatctgtgctcgtcccttttgagaaccgcaccattcaacatcaggatgaaaaaatcaaaatcgcccgctatgcgtcgcggtttatcgaggatcacgatcttgtatttattgattccggcacgacgaccaaatcgatgctggagacgcttgatcccgacaagaatgtaacggtgttgacgaacagccttgatattattaacgccgcttcatccatgaaaaatatcgacctgatcatcatcggcaataactacaaacggaagacaaggtcgtttgtcggcattgatgatccgagcacactcaataaatacaacattaacaaggcgttcatgtccgctaccgggacaacgatcacccacggcctgacgaattccgacttactggagtacgaggtgaaaaagaaaatttccgaaaaggcgaacgaagtgtatctgctcgcggatcattccaaattcggcaaatccacgcttttgacatacgcgcctttcgaccggcttcacagcatcgtcacttctcagcagctcgatgaggaatatacgaagtattgccaagagcaccaaatcgacattcacttggcatagcgttatagttaatagagaacgctgccgtattttcccggcaggcgctatgatatccaattttttcagggggcgaaaacatgagcaaagtaacaatcggcaaaactgacctaaaggtatttccgatcggtttgggaacaaatgcggtcggcggacacaatctctatccgaatctgaatgaagaaacgggaaaagaattggtccgggaagcgattaaaagcggcgttaccatgttagataccgcctatatttacggagtgggccgttctgaagaattgatcggtgaggtgctgaaagaatataaccgcgaggatgtcttcatcgccacaaaagccgctcacagaaaagaaggcgatgactttgttttcgacaactcaccggcctttttgaaacaatcggtcgaagacagcctgaaacgcctgcagacggattacatcgatttattctacatccatttcccggatgagcacacgccgaaggacgaagccgttcaagcattgaatgagctgaaaaaagaaggaaagatccgttccatcggcgtatccaatttctctttggagcagctgaaagaagccaataaagacggcttagtcgacgtgattcaaggagaatacaacctgctgaaccgtgaggcggaaaagactttcttcccttatacgacagaacacggcatctcattcattccgtacttcccgctcgtatccggactgctggccggcaaatacgacgagaacacaaccttcccggaaggcgacctgcgcaatgatcaggcgcatttccaaggggagcagtttaaagaaaacatcaaaaaagtcaaccagctcaaaccgattgctgaaaagcacaatgccgatacggcgcatatcgtgcttgcctggtacttggcgagacctgaaatcgatatcctgattccgggcgccaaacgcgcggatcaattaaaagacaacatgaaagcagcctccattacgctatctgctgaagaaatcgcgtttattgacaagctgttttcctaagaaaaaaaacacgcctttttgaaagggcgtgtttttttatgtttatatttttctcttcggggaatgaaatagttatctaaataaactattatgcgttccaaaagatgaggaggatcatctgtgaagaaaaacaccaaaaaatacctgatttactttttcggagcattgggcgggctgctttacggctatgacaccggtgtgatttcaggggctttgttatttattaacaatgatattcctttaaacacgctgaccgagggattggtcgtcagcatgctgctgctcggtgcgattttcgggtccgccttaagcgggacatgctctgaccgatggggccggagaaaagtggttttcgtcctttcactcatttttattatcggcgcgcttgcctgtgcggcttcgcaaaccgtcaccatgctgattatctcccgtgtcatactcgggttagccgtcggaggctcaacggcgctggttcccgtttatctatctgagatggcgccgacaaaaatacgcggaacgctcggcacattgaataacttaatgattgtaaccggaattttactcgcatatattgtgaattacatattcaccccgtttgaagcttggcgctggatggtcggtctcgcggcagtaccggcggcgcttttattaatcggaatcgcgtttatgccggaatctccgagatggctcgtcaaacgcggccgtgagcaggaagccagacaagtcatggaaatgactcacgacaaagaggatatcgccgttgaattggcggaaatgaaacaaggagaagccgagaaaaaagaatctacgctcggcttgctgaaagcaaaatggatccgtcctatgctgctgatcgggatcggcctcgccatcttccagcaggcggtcggtatcaacacggtgatttactatgcgccgaccatctttacaaaggccggactcggcacttcggcgtccgttctcggcacgatgggcatcggtgtcttaaacgtcatcatgtgtatcaccgccatgatcttaattgaccggatcggccggaaaaaactgctgatgtggggaagtgtcggcattaccttgagcctggcgtcactatcagccattctccttctggccggcctgtcagcttcaacagcttggctgaccgtgctgtttctcggaatctatatcgtcttttatcaggcgacatggggccccgtcgtatgggttctgatgccggagctgttcccgtcaaacgcacgcggagccgcaaccggatttacgacattgattctgtcggcaaccaacctgatcgtttcgctggtatttccgcttatgctgagcgcaatgggcatcggctgggtgttcggaatattctcagtcatctgccttacatccttcttctttgccgcttacatcgttcctgaaacgaagggcaaaagtttagaagaaatcgaaacgcacttgaaaaaacggttctccttaaagaagcgcagcaaacaaaatcaaattcttaaacagcgcacactgtaatcaaaaaaggaatcgccccgctgggcgattcctttttggcgtcataccatgactttgcagatatcattcgtaaactcgaccggatcatggatcggcagcccttcaatcagaagcgcctgattgtacagcaggtttgtgtataaagcaagcttttcccgatcttgtccgtgcgcgttctttaacgtctcaaacacttcgtgattcgggttgatttccagcactttttccgctttgacctgctggctgtcaggcatggcgtttaacactttctccatttcgatcgtcacttcgccgtctgtcgcaaagcagaccggatgagattttaagcgttttgaggctctgacattcttgactttatccgcaagaatctctttcatgctttcgaacaggtctttatattcgttttcttcggcttcagtctgcttatcatcttcgtcactgtcgatgcctaagtcggcgcttgagacggatttgaactctttttcctcgtagcttgtcagcattttgatcgcgaattcatcaatatcttccgtgaaatataaaatttcgtagcctttgtccgccaccatttcagtttgcggcagcttttcaatccgctcatatgaatcgccggacgcgtaatagatatatttttgatcctcaggcattctggacacatattcgtccagagtgacgagctttttctccttagatgaatagaagagaagcagatcttttaagacgtctttattcgcgccgaaatcattatagacgccgaatttcagctgtctgccgaaagattcatagaaagattcgtatttttcccttttgttcttcagcaggctcttcagctcggctttgatttttttattgatgtttttcgcaatcagcttcagctggcggtcgtgctgcagcatctctctggaaatgttcagcgacagatcctcagaatccaccatgccttttacaaagctgaaatgatccggaagcaggtcggcgcatttgttcatgatcagcacgccgttggaatacagctccaatcctttttcgaattccttcgtataatagtcaaacggcatgttttccggaataaacaaaatcgaattgtagcgcaccgctccatcgacgctgatatgcacgtgggtcagcggtttatcaaaaccgtaatgcttctcggcgtaaaaagcctcgtaatcctcatccgtcagctcgcttttgttttttctccagatcggcaccatgctgttgaccgtctgttcttcctgaacttcttcaaattcgttctcgctgccctctttcggcttgttgaccgtctcttccattttgatcgggtagcggataaaatcagagtactttttcacgatcgctttgatgcggtagttttctaaaaactcatcatagctctcatcttctgtgttttcttttattttcagggtgatttccgtaccgacggtttccttgtcacacggcgagatcgtgtagccggcggccccttccgactcccatacatacgcctcgtcactgccgagcgccttacttttcaccgtgactttatcagccaccataaacgccgcataaaacccgacgccgaactggccgataatgtcatggccgtctttcgagtcattttcttgcttgaaagcgagtgaaccgcttttcgcaatcgtgccgagattctgttcaagctcgtcttttgtcatcccgataccggtatctgtgacggtgagcgttctcgcttctttgtccgccgtcacttttatatagtaattgtcttgatcaaacgttaatgaatcatcggttaacgccttgtaatagattttgtcaatcgcatcgctcgcgttggaaattaactcgcggagaaaaatttccttctgcgtgtaaatggagttaatcatcatgtccagcaatcgcttggattctgctttaaacttttttttccgcacttcagatctctcctttaattatgctttgatgttatgtaaaatcttttcagcatctatttatcatatacagtgacaattgtcaactaggattagcagatgcatatattgtaaatttaacatgttaatggattcatttcacccattttatcaataaaaaagagagaatgttgatcatcctctcctctctgcttctttccggcggccgaattccttcttcatccatatgtatgacgggtagaaaaacaaactaaataagataagagatcccaagtttcgcaaagactcatgcagaacatttcttacagtgagaggaaacgtgatgtcctgaaacagaatagagataacggtgtaaatcacaaatcccataggaacaatggcataacaataaaacgctatctcctttttatgctgtatcttcaaaatatgtaaacctcccaatgatgtatatacataatatcaacatatttaataggtatttagaaacaaacctccgtatgtttatccccctattcagcgggaacagatatagaaaaaggaggaatcgcaatatgggaagattaacagacaaaaccgcaatcatcacaggggccgcgacaggcatcggacaagcgacggcacgggttttcgccgatgaaggcgcccgcgtgatctgcggtgacatcaatgaaagcgaactgaatgaaaccgtcagcgccatcagaaaaaacggcggagaagcagaagcctttcaccttgatgtatcagatgaagaaaacgtaaagtcttttgcagacggcattcagcaaaagtacggaacaattgatattctgtttaacaatgccggtgttgaccaagagggcggcaaagtccatgaatacccggtcgacctgtttgaccggatcatcgccgtcgatctgcgcggcacatttctgtgcagcaaatacctgattccgctcatgctcgaaaaaggaggctccatcatcaacacctcctccatgtccggccgggccgcagaccttgaccgctccggttataacgccgcaaaaggcggaatcacgaacctgacgagagcgatggccattgattacgccagaagcggaatccgcgtcaattccttatcgccgggcacaattgaaacgccgctcattgataaattggcaggcacgaaagaagacgaaatgggcgaggcgttccgtgaagccaacaaatggatcacgccgctcggccggctcggaaaaccggaagaaatggcggctgtcgcgctcttcctcgcttcagacgacagctcttacgtcacgggagaagacatcaccgcagacggcggcatcatggcatacacttggccggggaaaatgctgattgataagaagtggaaggaagagacggagtgacgatagataataaaaaaagccagtgcaaaaacactggctgaacaagctgagggcgggttacttaaaccagcccttttcctttgatcgggtaatggcttcaattcgatttttcacttctagtttatccagaatcatcgaaacgtaattgcggactgtgccgcttttgatgctgagggcgtttgcgatttctttcgtgttttttccgtctgcgacaagctcgagcacctctttttcccgttcggtcagcgggttttcttcactataaatgtcctccattaattcaggtgcatagacgcgtctccctttcatgacgctgcggatggcgctgacgagctcatcgctcgggctgtccttgagcatgtacccgctgacgcctgcttttagcgcccgctgaaaatagccggagcgggcaaaggtcgtcaaaatgatgattttcacaccgctgtccttgagttcttctgccgcttcaagacctgatttcccgggcatttcgatatccatcagacagatgtcgggcgcatgtttttccacgaaatcgatggcatcctggccgcttgtgcctttgccgacaaccgtcatatcctcttctaaattcaacagcgaaccgagtgcgccgagcagcatttgctgatcctcggcaatgaagatgttgatcatctgctaccatccttttcttttgattttgaatcattcgggattctcatggtcagctttgttccggcggctgtatcgatggctaaactgccgtttgcgaattcaagacgttccctcattccaagcaggccgtgcccctttgaaaaaaagcggtcttctctgcattgaaagcttccgtcatcttctaccgtaatgacaacctctttccaaagctgctgaatggtgatgcggcatacttttgcgccgctgtgtttcacgacattggtgacggcttctttaatgcacatgctgacgatgttttcgttcagcaaagagatatgtttgggcgcttctttttcttcatacacaaattcaattcctgccgcttcaagaatttgccgaacattgccgagctcatccttcaatcggatgcctttcatcgatgagacgatttgtctgacctcatttaaggaagtgcgggccgtctgctgcacgcttttcagctcagtgcgggcctgttcagggtccttatatatcagctttcgggcaaggtcgcttttcagtccgattaaggagagcttttgtccaagtgtatcgtgaaggtcccgggcgatgcgctgcctttcttccagcttcacaagatcggcaattcgctcatttgcatattctaatttctcctcaaggcgctcccgtgcctttctgcttcgaatgctgagcggaagcaggatggcactgatcagtgtaatgacgataaacggaatttgtgtcaaaaaccattcttttttcagaacaaggctgaagttgacggcaaccgccgcactgatgatatgaatgtaatataagatgtaaaatggaactttgtctcggatatggccgatgaagtaggcgataaagaaggcgaaataaatataactgaacagcatggctgagccggtcgaaatgccgatcagaagaagcgcccataagtaaagcggccagccttttgcaacaaatgcaaagcggtatgcgccaaagaaaacgagcgtgaaaatgatgccggccacgatgacgaaggtagaagagcttttaaaaataaaataaaaaggcaggatgaaaaaaatcgtccatatataaggagaaatcccgttcagtttttgaaatttaaaatacttcttcatctttgttccaccttctgctgcttgtgtctaccatcactttatcaaaacaccgccttcattgcaccctcacgcatgaagagaaggctctttctgataagagaaagagccgtgcgccgtatcaggcatttttctttaaaggttctttcggcaccggatggggcgccgatgttttccgcgcctcccggaaggtgacaaactgcttttcgtcctcatcccacagacggaatttcatggattcaagacttgttttaagcgtaatggtcggtacgttttttaaaggctcgtgtccctcatgagcggcttccagcttgtagttcggcaccttcggacttaagtggtggacatgatgatagccgatattgcccgtcagccattgcaaaagcttcggcagcttgtaaaaggagcttccttctaccgcggcctgcacataatcccaatgctcatcggcttcaaaataagaatcctcaaacgtgtgctgaacataaaagagccagacgccgattgaccccgaaataaggaaaatcggaccctgaacaagcaaaaagttttcccagccgagaagcaagcacgtcgcagcagccaataagacaatcgccgcgttcgtgaaataggtgttccagcgctccttgcggcgggcgccttttacattgaaacggtttttaatcagaaatacgtaaatcgggccgagaataaacataataaacggattgcgataaagtctgtagcgtatttttgtccaggctgacgcttcgttatattccttgacggtcatcatccaaatatcgccggtgccccgtttatctaagttgctgcttgtcgcatgatgaatggagtggcttcgctgccattgaaggaacggaaacagtgtcagcacacctgaaataaacccgaacagccggttcagcttcttttgtttgaaaaaggattggtggcagcagtcgtggaaaataataaagattcttgtcaaaaatcccgctgctataacagtacaggcgagggtcagaagataggagacattgaggctgaagtaagcaagaaaccaaagggcaaaaaacggcacaaacgtgttgaaaagctgaatgatactatgctttgtatcggcgccggaaaatgcggcaacctgcttttttaaagacgcttgtttttgagttgcggcgtgattgatcatgaatgtcatgtcccttctttttcattatgacctcaagtataacggggcgcccgacgcggttgtagtagcagccatcatgccccgaatatgacatttgtcatgtttggcggcagaatgctgatcaggcgtcatatggaaggtttctttcatatctgcacttctcaaagaaaacagcaaaaaagaacccggcctgttttcggccgagttctttttcatcatcctcacagcaaaatcacccgatacttcttcacatccaaaaactgcagaaactcccgggccagcatatccggcgcgtggtcttttccttcatgaagacgatattgaatcagaccgacgagcatggacgcgacatagtatgcatagagctttttgcccgcctgaatgtgcagaggctgatgaagataaaacgattgcagcgctctgaacatttccgggatgacgtcaggcactcctgaatcctctctcagaaaatgaacgagcggaaggccgtccgacagtgccgaaaagagccggacgagcgcggcttccgcttcttccacggaacagtcggcaggatctccttttaccgtcaataatccgatcagatcccggcatgattgatggatgatcgttttcagcaatgcttctttgttggcgtaatggtcataaaaagtggcacggcggaggttgctttgacgggcaatatcggaaatcgtgatcgccgcgtactcttttttttccgccattaagccgatcatggcttcttgcaaggcctgcctcgtccttgtcacccggcggtcggcgggctttttttcttcttgttccggcacccggcggccaaacagccagtaaaaccgtttttgagaaatcaaatcccacacctgtccgctgatttcttccggggatgccccgggctcctcattcagccagtacaacacaatggcatatgtgtataacgcgcggtaatgaatgtacatatcctgttcagtcggtgagaaatccgcattgactggtgacagcagcacatcatgccggaacacatcttttaaaaaagcatgaacgtgaaaatacggcattttatgacgatccatcatcgtttgaaaaaacacccggtgccggtcaacaaaagacagtgtcggatgcactttttgccatccgccctgtaaatgaagcacatctttattcttcagcgaatcatacagcgcttcgctcagcccgtctttcatttcttcctctatatcctctaaaatcgcatatttatcttcgtaataaaggtacagtgtcccccggctcacgtgcgcccgttcggcgatatccttcatggtcacacggcggatatcccgctctccaagcatggccaaaagcgcttgtttgatgtcatttgtcatagaatccggcataagagacactcctttcattagacagaacacggcaatttgtacggtaacgtatagatgcgtttacgctgtctttgccgcaaaaacacatcacattataataggccctgaagaaataaaaaagcaaccagaggaggaaaaccgatggatcagcatataaaagcagacatcaaacgcgtctttgcgcttcagaaaaaaaatcaaaaaacgctgcgtgcttcaacagccgggcagcgcagagaaaagcttcagcgctttttagatgccgtcaccgcacatgaagaagaaatcatcgaggcgatcagacgggacgtccgcaagccttatcatgaggtgaaaagagcggaaacgcagggaacgatcaaggcgattaaagataatatgaacaatctcgacacctggatggcgccgaaacgcgtcggctcatccgtcagccccgacgctgacggcgtattaatgtacgagccaaaaggccttaccttaattctcggcccatggaattatccgtttatgctgacgatggctccgcttgcggctgccattgcggcgggaaacagcgcgattgtgaagctgtccgattttacgatggagacgagccatatcgccgcgacagttattcgcgaggcatttcacgaagaagaagtcgccatttttgaaggtgaggtcgatgtcgcgacagaactgctcgaccagccgtttgaccacattttcttcaccggaagcacgaatgtcggtaaaatcgtcatgacggcagcggcgaagcatttgtcgtccgtcacgcttgagcttggcggaaagagcccgacgatcatcgacagcggctatgatttgatggacgcggcgaaaaaaatcgccgtcggcaaatttgtcaatgcggggcaaacatgtatcgcccctgactatctccttatgaaggaagatgtacaggacacctttacagatcttctccagaccattgtcaatgcaggttttatggaggatgatcatacggttgaccgcaacaaattcacgcagattgtcaatgaccgcaactttaaccgtgtcaaagccctgtatgatgatgccattgaaaaaggggcgaaaacggcgttcggcggcgtattcgatgctcatgaccgcacgatttctccgaccgtgctgacaaacgtcacgcctgatatgaagatcatgcaggaagaaatcttcgcaccgattctgccgattatgaattacgaagatatcagtgaagccgttgattacatcactgaacgggacaagccgcttgccttgtatgtattcagccataatcaggagctgatcgattatgttctgcagcatacgacgtccggcaatgcttctgtcaatgatgtcgtcgttcatttcactgacgtcaaccttccgttcggcggtgtcaatacgagcgggatcggttcatatcacggtgtgtacggttttaaagaattctctcatgaaaaaggcgtattcattcaagcctctaaataaaaaaaagaatccgcgtgcgcggattcttttttattatttttttgccccgaatgcgagcagtttcgtataagtgccgacgtagagcgtgccgtcttcagccagaaccggggaggaaatgacattgctgtctgtttgatagcgccatttttcattaccgtcagcgtcaaccgcatagacgtttttatcgtcagagccgaagtacacattgccgtccgcatcaatcagcggcgccgttctcacaggcccgtccgtatagaaagaccagttcatattaccggttttgctgatggaaaacagctcgccgcttcccgaaccgatatacacattgccgttatggtcgatcgctaatgaagagctggagaaaccgtttaacgggaacgtccactttacagcacccgttgatgtataggcgtataagttgccgtcctggtttccggcgtaaacggtgccgtctctatcaataaccggataacctttaaacccgttggacgtcgtttttgaccatttcacttggcccgttccggaattgatcgcgtaaaagatattattgtacgttgccgtatacagcgtgccgtttgacgctaacacgggagcggaaccgaccacgccgtttgttttaaacttccacttttgcgtccatgtcgaaggcgacgtcggtttaatcgcatagatatagttatccagcgtcgacacatacagcgtgccgtcagagccgatagccgcatcggaactcggcgctccgctcagcggaaccgatgttaaaatgtttccggtttctttgtcgatgaaatacagttttttatcgtgagaaggaagataaatgacaccgtttgttccgagcaccggagtcagcgtataggtcgtcccgaggttttccgtcacccatttcacagtaccgtccggatgatacgccgtcagcttcccgtcttttgattgaataaatacggtgccgtccccgtcaaccgcggctcccgcaccgttttgaggggtggccggaacattcttttcccattttaatgcgccatcggcagtgcttgtaaaccggctttcccttgaccagttgaacatcgtcggagacatcgcctgcgcgtcataccgtcccgccaagaaaccggatgccgcatgattttgtttaaataccgtttccgcggcttgagcagccgccggatgcagccattttgcccccggcagatcagaaaccgcccccacagataaagccgcagcaaccgcagcgccggccgccaatgttttcattcgcaatgaagctgtcttttttttcaatgtcagttcctcccgtttctattaaaaactgctataccgctttcatcataccataatcatcctatgaaatatttgtattttcggtagatttatagaacaaatgtcacatagcctgctgatgcttcggggaggatcgaaacgcggcaatataccacaccacattgacgatgaaagccgcgcctgaccaaacgaaaagaccgtaataaagagacagctcctgccctaaggaaattgcggtcaataacgccaccaacaagacagccgcgcaaatgataagcccgatcccgcaaaaaacagccatgatgattttcatgacacgaacaccgagaatatacataatgagcgggaccgcatatataacaaggatctgaccgacggcggcccacatgcccgcggaattaaaacgattcgcgttcggccccgtttctgcaagcggagaaagcgagacgaggaccggcaataaacaaaacatcagagcggaaagcaaggtcaccgcaaccgcaccttttttcttttgattcatgtgaatatcctcctgacaataacccggcttttttaccggtaatctgataatatgttatattttagcacgatatttacttaatttgagaatgttttgtcaaaaacgaatttacaaatccagaaaaatagatataataaacgttatggaaccgatattgattcataaagcgttatctaacaaaacacgaagtgatattatgacgtggcttaaacacccggaagaccattttgatgaaagaccttatcttgatcagggactcagtttccgcaccggaatttgcgtcggtgatattcaggcaaagtcagggcttgcgcagtccgtcatctccagctacctgctgacgatgcaaaaagccggcctgctggaatccgaacgaatcggaaagtggacctattacagaagaaatgaaaaacaaattaaagcctttgctgactatgtccagcaccagctataaccatgaaaggagggctttttttgttctaacatatctacttttctgtatatgtagttaaataaaaggaggcatacataacaatgaaaaaaagcagctccatcttcattctatttttggcactaggggttttcgggattatcacgaccgagatgggcattatcggcgttcttccgcaagtggcggacagatttcatatttctgcttcaaaagcgggatggcttgtcagtattttcgcgttcatcgtcgctgtgtcgggaccgtttttgaccttgcttgcttcaggtataaaccggaaatacattctgcttttagcggtgctgatgtttgccgtttcaaatgcggtctacgcgtatacggcgcatttcagtgtcatgctggcgtttcggatcattccggctttatgccacccggtgttcttttctgtagcgcttgcggccgcggcccggcttgtccccgccggccaatccggaaaagccgtaacgaaagtcttttcaggcatcaccgccggctttgcgttcggcgtgcctttcacgtcttatctggcggatcgtctctctcttgaagccgccttcttattcggcgctatcatcagtctcatcgcgttcacgggcattcttctctttttgccatccatgccggtcacagaaaaaatgtctttcagaagccagctcggcattcttcgcaaaccggctttgtggctcaatatcgctgccgtcacctgtctctttgcggccatgttttctgtctacagctattttgcggagtacctcgggcgggtgtcccatatgatcggcacatgggtcagcttcatgctgatgagtttcggggtgattatgatagccgggaatttcgtcttcggtgctttgttatataaaaatatgaaaaagaccgtcatcctgtttccgcttctttatacagccgcctacttgctcatatacgggtttgggacctctttcgtgccgatggccgtcctcgtcttcgtatggggcgccgttcattccggcggtctcattgtcagccagacatggcttactgcggaagcaaaggaggcgcccgaattcggcaacagcctgtttgtctccttttccaacctcggcatcaccatcggaacggcggcgggcggctggtttatttcacatttgggaatccatcagctgatgtggtgcggcatcatgtttgcccttctggctttcgggctgatcatgggacgcttggcatggggaaagaggctgctcgcagaagcttaagctccgttgcaaaatccggaatgattacgtataatattccagattaaagcaagggagagaaaaagatacatggaaagaccggcaggattttggattcggtttctggcttacgtcattgatcaaatcatcataggaattccgatttttatcatacaatttatggtctcttttttatttgcggcaggcgttgcggcggctgaccccttcataaccgaaaatcagtttaatatctcttttctggtgttcggcgtcatcccgattcttgtgagctcttttgtaatcagcatcttatatttcagcctgctcacagcctcaaagatgcaggggaccctgggaaaagcattgctcggccttaaggtcgtcaatgaagatggcggacgcatttccatcggccaggccttcggacgcgctttcgcctatatcatatccaagctcattctttatatcggattcatcatgggtgccttcggagagaaaaaaacgctgcacgacatcatgtgcagcacccgggttgtttataaataatgtccccaagtccgggccttttgagcccgggcttttttatgacggctgtgccctcctgatgtcaatgccgccttctccgtcagcctcaatgcggatcgtcccgttcacaatgacagacagcggatggaactccgcatgctgatcagaaaaaatccagcggcggccgctcggccctaaaagcaaaaacgccccatcattgtaatcacccataaaatgaaacccgttttcactaagaggcgcatgctttctcaccggaatgccgaaacgctgcagctccttccccgtcgataccacctcggcagccgtcagattcacctcaccgatattcaggacggactcaatcgaaaaacgttccgcgctttccggcgatgtgcctctcgcgatgaattccgccagattgttggacggatctttgaaataaaaggaacgcgcctgaatatgagtgaaatacacctcatcctccccatcttccgtttgaaaaacgactttatcctttatccacgccttcgcctcatcaaaacgattattcggaatgttaaacgcaaaatgatacgtcggttgagagtgagaatcggcgcgcctgaattccaactcactttctcccgccttgatggtaaacgaatcaccggactcatcaattaaaggaaaacctaacacccgttcatagaagtgtttcgtctcctccaacgcacaactgtacaaagtaatgtgatttatttgcatgatcataccccctttggtttatactgccatatagaggggttgattcctactgtttcgattcaccaattgagaatcctcctttcgcccggcgctacacatgacaagcagcgccaaaccgcttataccaggcgttattaaatgtctaaagcaaaaaaagcagaaaataataccccatatagcttgacaaaaaataaatgttatttaataatctatatataattagaattattattgaaagataaagtgaatgctttgtctttttaatatatttcaaatcacatttcaggaggaagatattatgtctttaatcggaaaagaagtactgccattcgaagcaaaagctttcaaaaacggtgaattcatcgatgtaacaaacgaagatttgaaaggtcaatggagcgttttctgcttctacccagcggatttctctttcgtttgcccgactgaacttgaagatcttcaaggacaatacgctgcactgaaagaattaggtgttgaagtatactctgtttctacagatactcacttcgtacacaaaggctggcatgacagctctgaaaaaatcggcaaaatcacttacgcaatgatcggtgacccatctcaaacgatctcccgcaacttcgacgttcttgacgaagaaactggtcttgctgaccgcggaacattcatcatcgatcctgatggcgttatccaaacagttgaaatcaatgcaggcggtatcggccgtgacgcaagcaacctagtaaacaaagtaaaagcagctcaatacgttcgtcaaaacccaggtgaagtctgcccggctaaatgggaagaaggcggcgaaacacttacacctagccttgatttggtaggtaaaatctaaggagtgcattccattggtacttgatgcaaatatcaaagcacaattaaatcaatacatgcagctaattgagaacgacattgttctcaaagtaagcgccggtgacgatgacacttctaaggacatgctggctctcgttgacgaactggcttccatgtcatctaaaatttcagttgaaaaaactgaattaaacagaacaccgagcttcagcgttaatcgtaccggagaagacacaggcgttacattcgccggtgttcctctcggccacgaatttacatcattagtgctggcattgcttcaagtcagcggcagagcgcctaaggctgatcaaaaggtcattgaccagattaagaacatcagcggagaataccgctttgagtcttatatcagcctgacgtgccacaattgccctgatgtcgtccaagcattaaacatgatgagtgtgctcaacccgaatatcacacatacaatgattgacggcgcggcattcaaagaagaagtagaaagcaaaaacatcatggctgttccgactgttttcttaaacggtgaatctttcggcagcggccgtatgaccatcgaagagattctcgcgaaaatgggcagcggcgcagatgcgtctgagtttgccgacaaagagccgtttgacgttcttgttgtcggcggcggacctgccggcgcaagcgcggcgatctacacggcgcgtaaaggcatccgcaccggtgtcgtcgctgaacgcttcggcggccaggtactcgacaccatgagcatcgaaaacttcatcagcgtcaaagcgactgaaggaccaaagctcgctgcaagccttgaagagcacgtgaaagattatgatattgacgtcatgaaccttcagcgcgcgaaacgccttgagaaaaaagacctcttcgaacttgaacttgaaaacggcgctgtactgaaaagtaaaacagtgatcctttcaacaggtgcccgctggcgcaatgtcaacgtacctggtgagcaagagttcaaaaacaaaggtgttgcatactgcccgcactgtgacggaccattatttgaaggcaaagacgtagccgttatcggcggcggaaactccggaatcgaagcggcgattgaccttgcaggtatcgtcaatcacgtcactgtgctggagttcgcgcctgaactgaaagcagacgaagtcctgcaaaaacgtctttacagcctgccgaacgtcactgtgcacaaaaatgcacaaacgaaagaaatcacaggcgaccaaaacgtaaacggcattacgttcgttgaccgtgaaacaggcgaagaaaaacacgttgaactccaaggtgtattcgtccaaatcggtctcgtgcctaatacagaatggttagacgaaaccgtcgaacgcaaccgcatcggcgaaatcatcgtcgataagagcggcgcgacaagcgttcccggcctatttgccgcaggggactgcacagacggcccgtacaaccaaatcattatctccatgggatcaggtgcaactgccgctttaggcgcatttgattatttgatccggaattaatgtaaaaagcgctaccctgcttacacggcaggatagcgctttttttatattaaaacggcatactgcatggcagtacaccgtctgaagtaattcaatctgtctttctccctctcgcccgatagataagaaacaatccaataaaccacagcggcgtcagcagcaaagccgggcgcgtcgcatccgcaaacagcataatcaccagaatgaaggcaaacagcgccagcacggcgtaattgataaacggcgcaaacggcgccttgaaagacgagcttgcgtgtaagtccggacgggttttcatgtatctgatatgacagacaagaatcacgccccacacccaaatgaaacagatcgcgctgatggttgtcacgatgccaaaggccgcttccggtatcaatttgcttaaaagagcgcccgctgacagcacaataaccgatatccataacgcgcggctcggcacatgatttttattcagcttcgcaaaacttgccggcgcctgttttgttttgcttaagttatacagaatccggcttgttgaaaacatcccgctgttacaagcagaagcggcagacgttaatacgacaaaattaatgattcccgcggctaacggaatgccgaccagactgaaggtctttacaaaaggactttccgttgcattcagctgcatccacgggttaatacataaaagaatgatcaatgccccgacgtagaaaaataaaatccgcaatggaattttattgatcgcggacggaatattttttttcggatttgacgtttccgccgccgacacacccactaattccacaccgacataggcgaagatcaccatctggaatgaaagcaaaaagcctgaaaatccgttcgggaacaagccgccgtgctcccacagattcgccgctgaaaccgttccggtatgcgttttgaacccaatcaccagcagaaccaccccgatgacaattaacgcgagaatcgtgactaccttaattaaggcgaaccaaaactccaattctccaaaaatcttaaccgttaacagattaagccctaataaaatgagcaaacagataagtgccggaatccactgcggaatatcaaaccaatatttcacatacacaccgaccgcgatcacatccgccatagccgtcataatccagcaaaaccagtaggtccagcctgtgacaaacgctgcacgcggtcctaaatacgcctcggctatatccgttaatgattggtaccccgctttagataacagcagttctcccagcgccctcatgacgaaaaaaagcgcaatacctacaataaaatacgcaaagatgatagaaggacccgccagctgaatcgccttaccggaccctaaaaacaatccggtaccgatcgtgccgccaatagcgatcagctgcacgtgccgattcgataagtccctctttagctctcgctgctccacatctgactcctccttacctctctagtgaacgacgagcaaaaaaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaacccgcggtctctccagaagccgctcctgctgtagtgcgacccacagcaatcatagcctgctacgtattgagtttccgatagaaataactatcagctaactttttattttaatggaagttgaatgcattgtcaacaggggtatacgctcacagcgttatcccggtccaatttttgatgcctgaagcgccgtatcttccgttttcattgtctcaaaaaggcgttatgcggtactatcatataaggtctaatcatttaaacattatgtcatactttaaattcactttatcatacaattgctcgtaaataaaaaggggatggacgagattggaaaccaaatatttagatctgctcgcacaaaaatacgattgtgaagaaaaagtggtcacggaaatcattaatctgaaagcgatactgaacctgccgaaaggaaccgagcatttcgtcagtgatctgcacggggagtaccaggcattccagcacgtgctgcggaacggttcaggaagagtaaaagagaagatccgcgatattttcagcggcgtcatttacgatagagaaattgatgaattggcggctttggtctattacccggaagacaaactgaagctgatcaaacatggctttgatacgaaagaggcattaaacgagtggtataaagaaacgattcatcggatgattaagctcgtttcttattgttcttccaagtacacccgatccaaattgcgcaaagcactgcccgcccaatttgcttatatttccgaagagctgctgtacaaaacagaacaagccgccaacaaggaacaatactactccgaaatcatagaacagatcattgcgctcggccaggccgataagctgatcaccggtcttgcctacagcacgcagcgattggtggtcgaccatctgcatgtggtcggcgatatttatgaccgcggaccgcagccggataaaatcatggaagaactgatcaactatcattcagtggatattcaatgggggaatcatgatgttctctggataggcgcttattccggctcaaaagtatgcctggcaaatattatccgcatctgtgcccgctatgacaatctggatattattgaagacgtttacggcatcaatctgagaccgctattgaaccttgccgaaaaatattacgatgataacccgtctttccgcccgaaagcggacgaaaacagaccggaagatgagattaaacaaatcacaaaaattcatcaggcgatcgcgatgatccaattcaagcttgagagcccgattattaagagacggccgaactttaatatggaagaacggctgttactggaaaagatcgattatgaccgcaatgaaatcacgctgaacggaaaaacgtatcaactggaaaacacctgctttgcgacggtgaatcccaaacagcctgacgagctgctagaagaagaagcagaagtcatggacaagctgctgttttctgtccagcactccgaaaagctgggccgccatatgaattttatgatgaaaaaaggcagcctgtatctgaaatataacggcaacctgttgattcacggctgtattcccgtcgatgaaaacggcagcatggaaacgatgatgatagaggataaagcttatgcgggccgtgagctgctcgatgtatttgaacggttcttacgtgaagcgtttgcccatccggaagaaaccgatgatctggcgacggatatgacgtggtacttatggacaggcgaatactcctccctcttcggaaaacgggccatgacaacctttgagcggtatttcattaaagagaaggaaacgcataaagaaaagaaaaacccgtattactatttgcgtgaagacgaagcagcctgccgaaacatcctgaaggaattcggcctcaatccggatcacggccatatcatcaacggccatacaccggtaaaagaaatcgaaggcgaagatccgatcaaggcaaacggaaaaatgatcgtcatcgacggcggcttctccaaagcctaccaatccacaacaggcatcgccggctacacgctcttatacaattcctacggcatgcagctcgtcgcccataaacactttaactccaaggccgaagtgctgagcaccggaaccgacgtcttaacggtgaaacgattagtcgacaaagagcttgaacggaagaaagtgaaagaaacaaacgtcggtgaagaactgctgaaagaagtggcgattttggagaaactgcgggagtatcgttatatgaagtgaagaatatggagttcagagataattctctgggctctttttttacggttgcgaactaagaagtccctttccctgtatgtaaaacggatttaaccgcttcttcaatctccctgtaacccgtacatctgcaaatattggactccagccaattttttatcgtgtcatcacttgcattcggctcagtattcactaaagcatgacaattcatgagaaaacccggtgtgcaataaccgcattgaaacgcgaatttttcaataaaagccttttgaatcggcgtattgatcagtccttcaattgtcgtaatgtcctttccttccccttctgccgcaagcattaagcaagatttcatcggcaccccgtccgttaataccgtacaggcgccgcaatccccatttaagcagcccggttttgcaccagttaatccgagacgaagacgaagagcaaataacaaagtatcagccggtctgaccgtcatctgtctttcctcgccatttactttcaacgtaataagatcagacatttggacctccttctaattcccgtaaggcatctaaaattgtatgttgcaagacaaatattcggtattcacttgagccttccgcatcatcaagaacgggtttgggtacatactgtaaagacctgcgcgctctatcttctaatgaatagcttttatcgttaagcacagcctccatttcagcagaacgaaacggaaatggacatacgccgctgaaggccattctgatctcatcatcttttttcagcgcacagactgtcaccaatggatacccgacattccactgctgtcttcttttgatactgacaaacggcaggtcaacgtacgctcgatcgacaacgatatgaaatagaaaatctccttttcgcaattgtatttccttgttaaatactttatttataggatggtaatgaatccccgctctccctgcaatccctagcaaactatcagaaatcaacaacggcagcacggcctcacggtagtagatgcccccgcaaatgtttccgcccaggctgatcttatttcgagtcgtccgatcggctatttcacttaccgttttacttaatagcggaaatggattttcttcctccagtttcgttaatgacacgcccgctccgatcaccagataacgttcataaaaacggatggcgtgaaattccggaagcgcgttcatatctatcaccgcatccgtatagacgatattcagccttcctaacgtgataatttccgtgccgccggaataatacatcggtgttttcttttcagccgcaagcgagtgaaatagattgattgtttcttgaatggtcttcggtttaaaataatcaaaatcaaacggtatcatctttccacccctcttgcgtcctccataattgttcgggaatgagaggaagttgattcaattggacacctaaagcggcggaaaggcaatttcccaatgcggccggcatccccagcagtccgtgttccccgccgccgcgcgctccataaggcgcaatctcatgcggggtttcaacaaattcaatgatatattcaggctgctctccatagtgaagggggcggtatgttctaagctgaggatttaatactctgccatatgaatcaaagacaaaggtttctcttcctccgaatgcgattcccatactcatcccccccatcacttgaccccttgcagctttttcattcagtacagttcctatatccacaacagaataggcttttgtaatccgatacgtataatcccgcttatccaactcaacttcgattccctgagcacctacagcccattcgggtcccggctttcctcttcccgtttcccggtctaaattcgtcatccgggttaatgtgtaattgccgctcgcaatgatttggccgccaatggtatttccattcggaaacgtatatccgtaagcaatgtcttttatgtcaacatgtacagaaggatgatctataaaataaacctttccgtcggccacttccaattcctcgacaggaacccgcaacacacatgatgccgcgtccttcagctttcgaatggcttcttccgctgcattcagtacggcttttccggccattaacgtccctctgctccccacggttttccaatgctcgggtgttgtttgtgtatctacaagcatttttacgtgaattttgcttatatccattttcattcgttccgctaagatttgggctagcactgtttttgtccctgttccaatttccactatccctgacatcaaattaatgcttccatcaggattaaaggttaaaatcactccggacgttgcatttgtatcaaatgttgaggttttccaaatacagctgattcccttcgcccgtatcttccggccgtcgatttcaattcgctgtccctcgtcccaattcattaattccttcaatctttcaatacatttcggtacatttccgaccgtgcttgaattgagaagaacttgagtcggtgtggtgtcaccggggcgaatggcatttttatagcgaagttctaacgggtccatgttcagcttttccgccaatacatccatcgtccgctcaaaagcaaataacacttcagcatggctgtagcctctgaatgcacttggatatggatgattcgtatacatacaatatgaatcacacgatatatggtcgatagcgtacggacccgtacaatcaaccaccgcagcccggctgatgtccactcctttatcagagtatgctccgccatcaaataaaagctgaatgtccgccgcctttaaaattccatcctttgtggcccctaatttgacaatggcatccaatcctacatgaacgggagatgtgatcatatcctcttctctcgtattaaacaatttgacgggccggcctccgactgcttttgatgccaaataggcaatcacctctaactgaacggctgcttttcccccgtacgccccgcctactaaaggcgttttgacgataacctttccgggttcaattccaaaataccactgcattaattttttaatggcaaaaggagcttgagaggatgtggtaatgataatctcctcatccgcccgaatttcagcgatcgagcatcttgtctccatcgcagcgtgatcagaagggttaaaggaaatctggaagtctgctgtcacatcactttccctaaatccgtcttcaatatttccttttctaaccttatccaggtttgcgatatttgtcttcggaaccgggaatacaccttttgtcttctcatagcggtccgcatgttcatggacgagcggcgcatccttttgaaaggcctcacggggggaattgacgacgggaagaggtttataggatactttgatggcatccgcggcctttttagctgtaatcggattttccgcaacaacaacagcaaccggctcaccatggtatctgacccttttgtaagcaatcggcgatctgtctttaatttcctcacctgcaagcggaaaaggttcatcccccaatatcgctctcacgccgggaatcttccaagcttctgaaaagtccatcgacacaatatcggcatgagcatatggactggtcagcatttttgcgtgcaacgtccctgtttcttgaaaatcatccgtatatttcgctttacccgtcactttttcaagggcctctttccgaatgacactcttcccgatatactccaactcattcactccccgaatttattcagcagcagcctataatcttcaactgtatcgacgtcataaaaaagcaaagggtcttgaaagctgatcatttttcccgccttgatcatactttcacggatgacatgccgggcgccctgatctccctttaattgatacaagactggaaaacattgattggagaataaaatggggggcataggaagatgctgattttcagcggcgataaatgaataacggcgctctttttgataggaatcaattaacgtattgatgatatctgcggtgacaaacggctgatctgcaaggagaatgataacggcgtcagcctcgtacgctgccgctttttttacaccgcattgtatagaatggccttggcccttacccgcctgctcacattctgcctggctccacttatttgacatgggatctaaaaagaaaaaatccgaaagccaatgcagtgaatctccctttcccgtaataacgaaaatatgatctaattcagataacaaggcatgtttaagagccatacttccaagggaaacgccattgagaaataaacttcgcttatccgttcccatgcgtctgcttgtaccggctgccaggtatatggctgctgttttcataagcgggacctttgttttcgcattttttgaatcagctcgccgacaatacttacagcaatctcttcagggccttgtgccccgatgggaaggccgataggggaatgaatatctgccggaatctctgccccgcctaacagccgctccgtgcgccttctggggcctaaaacgcctttataaaacacattctcgttttttattgtatgtaaaatgatctgatctttttgaaagctgtgcgtcataatgacaacaaaatccctttttgtcatgctcaggccttccatgactttttccggcgctcccgttatcaaatggccggcttcaggaaaatggccgtgatgacataaggcgggacgccagtcaatcaccgtcacatgaaagcccgcacgagccgccaacgaaactaacggcctcgcatcttctcctgctccgaagacatataaacaaggttttggaaccatctgatggataaaaaataaatcagatgtatgttcatcccttttgattcccttttctgtctgtctcagtttttgaatacagccttgttccatatccccgcttccaaacactctgccgtcttcagcgatatacagatcttccttcggctctaacgtttcagtgaatcgtttcactcgggtcacagactttttttcatctaagcatgtcttgactgtcatcagatttcgttccaattccccttttacaggctcaagcaacaccgtcaaagcaccattacagccaacaccctgcccccaggataaatcgtcctccgcactcatatcaaagcggacaatcaacggttctcccgcagaccagacctgctctgccctttcaacgagatcttcttccagacaaccggcggataacattccgactcttgttttatcctctaaaatcaacatcgaagccccttctttcttataagcggacccctctgtttgaatgatggtagccagtaccttagctttcttagaattagcgatgacatccaaaatccggtgtatatcatccatctcatgtcccccgcttttacctgatcatatctgtatatccatattctttttttccagaaaacattacaaacgcttcagcaatttcttcgtttctaaaaaaaaagagtctttatagaccttatgaccgggcggcgggtgcgacagcatgtcggagcggagagattccaataacacgttctgttccttctgtttccgattgtctgtttcgccctgctgtatgcctttaaaacccgcaaaatattcacttaacacttgtaaattattccccagctcccttttgtcacttgaagataaagctccttctttttcccattcttttaacgttttcactatatttgacagatactcaaatccggcgttcaacttttgcatctctatttgatagcttgaaatgatgtttttatgtttttttctgacggggttgaattttaagctgtcagaggctgtttgcagcatctcttttgtcatatgcagctcctgcagaagatggttcattttatattccataaggttcccttttccttgtccccactctgattgcacccatttggaaaggtctgaaagtgtgccggaaagctgacgggccaatgtttgaaaagagtccgctgccttttttgtgtaatccggcggaaacaggaacatgtgaaccagaatcgcgatgatgacgccgatcaccgtatcgatgattcggtcgaatgcataatctttagagtttcgttcaaacgtaaagaccaataaaatggtgagcgctgcctgatgcagaaccgttacatctattcgcaaccacttcgctatgtaagtaccgcctaacaggaacagccccagcatccagccattcattggcaagtgactgacaagaaaggacgttagcatgatcccaatcgcagttcccgcaatacgatgaaaagaaaaacgaatcgactgatctatcgttggctgcaaacataagataacagacagaggcgctaaataggggtgatcagagcccgccagttttgccgcttcccaagcaatcgcagaggcaatcgccatcttccaaaccaaagatgttttgttttgaattttttcacttttcatcatacgccccctcctttcagaaaccttttccactaggtttccgtgacggaaagggatttatactgtcgtatggaaaatgcggaagaagctgttgtttgcaataaaaggtgcttctctgagctcttctttacggtttctatcctcattgataacttcgcatcagatatgaaccctgctctcctatgactttcgaagggaaacatacaaaccttgttggttaatgtgatgaaattgggtgaattttttatcattttatatggtaagggtttaacaagcagaatgcctttgttagtatggcaaccaaaggaggaggatcaatgatgcaaagcagaatgaagctaaccgcagtgaaactggcagccttggtattcctagcaggtgcctttgccctccaggttttacctcatgctgcggctgccgcagaatcccaagctacatacaaagttgaaaacctcaacgacagtgagctgaagatgacgttcaatcatgcagatgttcaaattgacgctaaaggcaatgcaaccctaaaagacaacataacgggcgaggagcaggctcttccgaaaagctctgctgacaaaaatggtgaccccgttacactgaaatatgaaaaaatcaaaaatggcgttttagtcaaagtcgtaaacaaagacgctggaaaaacgagcggttcaatcagcacccaatcagtcgggaaatgtattttaggtactggcggcggtgcggtaactggcggcggcacactgggtcttgccggagctgctgtaggaacagtcacaatacccggtatcggaacagtaggagcgggtgccgtcggagcaattacgggcgctgttggcggtgcaatgacaggagctgccgcatcttgcttttaaccatgaagaaaaaggggcccgcgcccctttcttttactaactatggaaggtggtcgacatgtacaaaatcatcattccttcaatactagccatcttcattctctggatactcttacagatttccctggagataagcatcgttaagaatccattgaattattttattgtattcattgtcttctttctctttattaagatggtgaaagagaagcaacagtaggttgcttcttttagctgtggaaaccggatttgtagtggatctggtttttttgtgttttattcactataagttaacaggagaattcgcagtaaaattgaatattgacgacaagtcattgaccctttaaatttttaagtttacttacaacctaaaaatacagttattagaatttaatctatccatttcttcatgattatggatatgatatgatataatgtatctatcatctagaaaggattgaattttttgactagcaaatcagatgaatttaaaatcatttctgtttttaatcataaaggtggtgtaagcaaaactaccacaacttataatattggttggaaactagcagacaaaggatataaggttttattagtagatggagatccacaatgcaacttaacaggtttactattaaaagaggattttgaagattattatgtgggagagaatagctataataatataaaagatgctgttcgtcctgcatttgaaggggcacctcaaccaattaaacctattgagtgttattcaccatcagaaaatcataatctcttcttgatacctggccacatggatttgtcagaatatgatccagctcttagcttagctctgaatagtaataatgcaattactactctccaaaacctaccaggttctttttatgaactaatacaactttgcgtcgacaaatattcaattgactatgtattaatagatatgaatcctggattaagtgctataaaccaaacattttttatttcttctgacgcatttataattccaacaaacccagatccattctctataatggccttaaaaacaatgagcaagatactaccaagatggaaacaatgggctaataactttgctcccgttttttccagtgcaacatatccactcccacaaagaagccctaagtttgctggtgagattattcaaagattcaatttacgcaataagaaacctgcagctgcttataaagataagattactgaaattcagaactttattgagaatgacttcctatctactttaaaatctgttgatatggtatacgatattacagaatctaaagcagctaattatgtcgattcgtattgtttagctcaaatacccgaatttggcgctttaaaccaaagatctcatgaacatggtgtgccaattttttcattgagtgaagaacaaatgggaacaaccggaccagttaaagctcagatgttagagaaacaaagagagataaatttcatttttgaaaaattaacaaacgcaattgttaaaacaataaaatgaatttggcaatcaatcagtttaaaataataatcaaagaaacacagcaaatgacaactgtttatgagcactttaaaattccattagatgatttactaagatggcagtggactcaggctgtctcagccttagataaatatatacatgacataataagaattggtctcattaaaacatttaataaagagataacccctaccaaaagttttaatagttttcctatacctgtttcaattattgatgactcatcttttatttcacatgtatttgaacaatttatagttaaaaaattggcttttaattcgtatcaaactgcagaaaagattaatgaagggttatcattaatttggacagaatcgcataagtggcagactatttcaactcaaatgggggtggaaaagaatttccttactaagaagttgaatcttattgctcagaggcgtaaccaaatagtccaccaaagtgactacccctcattttatcttgaaaaagaaaaacttaatcctgctcaaactgaagatgtaattagttttattaatcaaatagttgaaataatacattatgaattacaaagagaattcaccaataggaaaataattaaaaaaggtaatctacgttgattacctttttttaattaccccatttagaattaactgtacaaagaacaaacatactaataacaacataccttcaatattgaaaaatattgaaataaaaagtcgaattaatacagcttatggaaagaaggattccttaattattaaaattgagaatgttaaactttttaccttctttttttcggttctcaaaccatttttttaagtactcatcactgactaattttctgataagtagtttttcatgttggttcaactgtctacctaagctttttctaagtgttatatatgatttgataattgaagctagatatataatattaacctctaaagaaatggtaaaaagttgattattatctagatggttgtttcttttgaaacggtcataattactcatacctaaaggaaaggaatggacactattagaaaataaattatatatacctttctctacatcctcatttacagtactcatttttcttttaatacgataatttaaataaggttttttacctcttataatttttctctttgtagttttatctaaactattaaactctgggtaatctgcacttagattctctggattggttacaaaattactatgtaactgcatcatcgaatcatattcatcgaaacccaatttctttagaatgttaactgtgcatttactttggtaatatgccaacagttccattctaaaagacaattctgaactactaatacctatttcacataaataattatatacgttatgagtttctataatatttcttgagatacttacaagcgtacctacatccaagaatcttaaatcttttttttctttaggaattaaactcatataactatttgcgtttaaaattgctttatttaatagtgtttctccataaaatgctcttaaagtagtgggaggtatatttatatctattaaacttttccctattttaataagtgctttaaaagcatctattcgattaacaatagaaataaagatcacctcaattataattcaatttatttatgataaggctccccacgattaatccgaaacgcccgataaatctgctctacaagtatgagacgcatcaactgatgaggaaaggtcatcttcgaaaatgacagtttgtcgtctgcccgtttcatgacggcgtcgcttaggccgagtgagccgccgatgacgaaggtgattttgctttttccatatgtcgccagcttatctattgtatcggccagttcttcggatgttttcatttttccttcgatggcgagggcgatgacgtgggtgtccgggctgattttggccaggatgcgttcgccttctttgtctttgacgattttcatgtcttggtcgctcaggttttccggagctttttcgtccggtagttcgatgatgtcgatttttgcgtaggctgagagtcgttttttgtattcttcaatgccttgcttgaggtatttttcttttagttttccgatggtcacaatattgatattcacaggtcatccccactttagaaacaagttattcatatatattatccacaattgtggatatcttttctgtattttgtgtaggatcattcgttccctactagatatgttgcagtgtccccacataattcacaggctgtggataaactgttagtatgttcgatttttctgatttcgggcggaagctcatgatcgtctatgtacatgtccagcacggtttcgatatgttcttcacaagaataataagcggttttcattgttacatcctccggttttcttttgcgcgcggcaattgttctcttttcaatataacctatttatacacatgttagtagtgcttcgggctgagttttatccacaattcggcaaatgacgcgcaaaaagagccggcgtttgcagcatccggctctttacgtgttttctcttttttctaagcgaaggacgaacagaattcctaatagacacgccagcagcgtacagcatacatcaatccagtccggctttccgccgtttagaaaagagttggttatcacggaaaccaggagaatggttacggtcaccgcggcaagctttttcttcatcggctccctccttcacctgactgtcttctgcttttacggttcaaattcctctatttctttttcttgctatatagccttatcatgagggtcacaacgatatatacaatcataatcaatgccccgttactcacatcagggtatccaatcaatatattcattatgacaaaaacaatggttatacaaatgacggacaacaataagaagatactgaatgatttcaaatgaacaccttctttcccgcagtaacgtttcattataaaaagcttaccaaaagcggcaagctcttccgaaatgttcatactctttaaaacccatccatcacctgcacatcatacagcttgagatggcttttcggcgtgacgatgttttttaagtttgggatggtcaggtcgttcagttttttgcccgttttcaggtcgaaggattcgattttggcgggctttttgtagctgtacgtgaacagatacagctttccgttttgatgcgtcagttctttaaagtcggccttcattcgtgatgcggggagggtgaaggcctttttgctttttccggtctcagggttgatgcggtagacggttccgaagccgtcaacgaaatagaagctgcgatgctccatgaaaaagctttttttgaagctgaacggcatggagtcatagatcgtctgttcgtcatttttataagcggcgatgtcatacgttttgatggcgccgctgtttttcatgactttcaccatttgatagatgtgatcggctttttctcctctggtaacaaagcagacagcgctgtcgtccacggcgagctgggattcgacagacgtgccttctttatacgtccacgtcgcgattgatgttgtatggagcttttctttatcggcctgaatgtcttggacgtgatagcctttttcgtcatctgtcggcgtgagcgcgaaaagatgatctttaaaaaagcctgaggcgcggatatagtgcgggatgacgtcttgcttccacctgccgtccatctggcggtacagctctgagcgatagctgccgccgctcttgtcgtagcccgaattatacagcgtgtaaaagcctttcgcccgttcgatatatcccgcgctgtctcccgtatgctggtacgctcttttatacgtgtgaaggccgtcctgaacggtgtagattccttttttgtcctccagcagcacgctttcgtcatgcactttggccgatccgagctcaagccccttcatttgataagaagaaagccgccctttttcatcggcgaagagggcgtagctttttccgccgccgaacgtgtcttggtcagccgcagtggagaaatacagcaacgcctctttatctttcagaaaatcagggtcatttaatgtgtctctcgcaacctccgcagggtcttccgtgcggaaatagaagaagcataagaccgctgcggcggcgatgatcactaagggtatccagatgatttttttcacgttgttctccttagtgaatggtcaggatcgtggttgtgtaggacgagcttgtgatgtcgcgcgggtatacgcctaagccgccgttagagtcgatatcaatccccgcttttaaaaggaatgccgaccacagcagttttgagcagtttttggcgccttcatggcccgtatttctgttattgacgaagttgaaggagtactcatcacccactcttgatacggcccagtcagcggcggcttgtttttgagcatcggtaactttcacggtctggacgattgaattgtcttcgacttctctgccgttataagcaatctgacggacgccgtctcccggcacggattcgacaattttatcagcggatgaatacatgccgacatgcccgtgattgtaataagccgtgtatgagttcgtgtaataaatattgccttttgtgcttttcgggagttttttggttcctgacgatccgcccatcgcagagagtccgtctttggaagcgattacatttccttgcaccttgtctgccgtgatttcttgatgaaactgcttgagaattgcttctgttgaaacatgcttctgtttggcaagctctttggcggattggagaacgtcttcaggagtcgtgccctgctgaaggtctgcgatttcttttgcgtagcgtggtatttctgtttctttcgcttttacattcaaaccggagaacgacagaaccatggtgaatgacagggcaaacgggaggacggctttgaacagctttttacacattgacttcgcctcttttctcaaaggttaatttttccacgttttcattatatgacgaaattgtgataaaaaaatatacaatttacagatttttaaaaattttataacaatatgtaaatcatatacataaatcattttcaaatatcaggaaatctggttatcatacaagaaagggggaggacatatgaaggacagaacgatcggttcgatgcgggtttccgcaatgggattagggtgcatgggcatgtcggaatactatggcagccagagtgaggaagagtcgatctccacactgcatcatgccgttcatctcggcgtgaatttgtttgatacggctgatcaatatggattgggtgcaaatgaagaacttgtcggcagagcgctcgccccattcagaaaggagctgtgcctcgcgacgaaattcggttatgtccgaagcgaaaagggtgagtttatcgaaatcaacggacggcccgattatgtgaaaaaagcgtgtgatgccagtctgaaacgccttgggacggattatatcgacctttattatctgcaccgggttgatccgcgggtgccgattgaagaaactgtcggcgccatgaagaagctgattgacgaaggaaaagtgaggtatatcggattgtcagaggcttccgcagaaacgatcaggcgcgccgtccgcattcacccgattgccgcgcttcaatcggaatattctttatggagcagggaagcagaggagcatgtgctgcccgcctgccgtgagctcggcatctcatttgtgccttacagtccgctcggcagaggttttctttccggaaagatgacgtcgacagatcagctggatgccgatgattaccgaagaagaacgccgagattccagggagacaatttggcggtgaatatagggctcgtccaaaaatttaccgccattgcccgggaaatgaatatcaccgcgcctcagcttgcgctcgcatgggttctcgcaaacggcgatgacctcattccgattccgggtacaaaaaagaaacactacttggaagagaacctcgccgctctcgacattgtgcttccggaggatgtgaaggcgcggttggatgaaatgtttccgatcggcacggcggccggcgagcgttacccggaacaaatgatgacattgttagatgaataacaaaagaggcccatcgtgcgggcctcttttcatgacagctttttgctcataatgacatccgtctccaggaatcccgtcttctcatacagcttccgcgccgtttcgttatgagcgaacacatggagagaaatcttgcggacacccagatctttggctttgtcctccagccttgcgagcgcctcttttgcatagcctttgccgcggaaaggcggatgaaggccgaaatcataaataaatgcgtcctgctgcgggtggtccggatcggcgtgcagccaaagccagccggcattttcctttccgtccaatgtcagcgtccataaatagtgatcggctgtctccaagccgtctggaagcaggtcttcaaacgccagctccgctaattccggcgcttcttcaggcagccacgttcccgcttttaccttttcttcagcgtaatgcttggttgaatgagcgagataggactgaaattcttgtcctgtcatcggctgcagcgtgatagccattgaatcactccttacacgaaagcggtatcatgcagtattatccgaaggctccgttttccgccggttttatgatttgttcggcttgtgccgttgaaccagtttgtgcaaataatccaatcgaaatgagacttgccaaggctgctgagagtacaatgaatttacatgttttcattacgaatcccctccgttaatctcaaaatttggtcattggcatcaattgattcctgaaaatacttcgccgccggtttgtatttctcctgttttttaaaatgcgccgcggcctgatacgacaaatcggaaacgtcactccacagctctttccttcttaactcggcgaaagctgattcaagcgcttcttcattgcggtcaataaagacatgctgtaagatgcgcagcttttgggtgtatacgggctcgtttttttcttcagcggcattcagcgctttatgcagccaaaaccggccctcatccgtcttttcctgcttcaataacactctggccagcatgtagagactccgcaccgaatacgctgatcgcaaatgctccttttgatcaagagccgtttcaaactcgacccgcgcctcttccagtttttcctgtctttcatagcaaatgcctgcgttaaagtgggcgagcgcttcaatatgcggatcgcccgctttggcggcttgatgaaccgccgtctgcaggagctcttcggctttctgatagtggaacaagtccattctgttacagccgatcaccattaaacactgtgcttctctgaccgcgtacatttcattggctttgtagatctccaacgctttttccgcgtggttcatcgcaaagtagttttggcggatttcatagtaggcaatcgccacttgataattaaactcggctctttcaatctcattcggtatgtgccggagcctgctttcagcaatccggtaaaaattaatggcgttcataaaccgtttacggtaaaactcgtgcattccggaaaagaaataataatagtattgaatcatctggtctgttttttctttatcggcgttcagctggatcgtttttaaaatgccgtctgttttctcatactcttccattaaaagcttatagcgggaatcaattaaattaaaataaaggagcaccgtttgattttgtgtcatattttgcagatccgtaagcagttgttctcttaacgcctcagccgattcagtgttgtgctttttgatttcctcataccagtcactgatttttttcgcaactgtttcgtgggccatcacttcagccatctgtcaggacacctccctttcccattttgtgtaataaatatatcatatttacaggtccaaaaagagggtggcagcccgctagtttcctcgtggcaacaaaaaaaacctccgcaggtgcggaggcgcatattttataatagtttttttcctaacaaagattccaccagctcgaccgctgttttgccggttttgtttttgtgatcgaggatcgggttgacttcgacaaattccgctgaagtgatgatgtcggcatcatacagcatttccattgccaagtggctttcacggtagctgatgccgccgacgacaggcgtgcctacgccgggtgcgtcgctcggatcaaggccgtctagatcaaggctgaggtgaacgccgtcacagtctgacaggtagtcaatggtttcttcaatgacctttgtcatgccgaggcggtcaatctcatgcatcgtatagactttcatgcctgtttccttaatgtattcacgctcgccttcatcaagcgatctcgcgccgatgatgacgacgttctccggcttgattttcggggcatacccgcccagattcaccagcgtgtcgtgcccgacgccgaggctgacggccagcggcattccgtgaatattgcctgacggcgatgtttccagggtgtttaagtcgccatgcgcgtcgtaccagatgacgccgagctgtttatagtgctttgccgttcctgtcagcgttccgatcgcgatgctgtgatcgccgcccaagacgagagggaaccgctcattctcaatgacgctgtccaccttttgggcgagctgctcgttccccgagagcacagagttcaaatttttcagctcttcatcatgtttgagtttttcacgattgacggggatgtcgcctaagtcttccaccgcataccccatgtcagataaccgttcaatgagatgcgcgtagcggatggcgctcgggcccatgtccactccgcgtcgtgcttgtcctaaatccatcggcattccaataactgagatattcttgttcatccgtttttccacctcaacatgttgtatgttgtcctgtgcgggtttctcaaagatgacttggacacgaaaagatttaaagctctatctgtttttctgactgcttatgcttttttacatacagatgatagacgataacgcacaccgccatgaacgggatgccgcaataaagggcgagccgctgttctgaatcaaatgcgaggctgatcagaacgaccgtgtttaacgtcagcccgataataggcagcaccgggtacagcggtgttttaaacttcaggtcttccactttgccgccttcgcggatgtatttccgtctgaacatcagctgtgacagggaaatcgtgatccagccgacctgcgcgcttagtccggctaatgataagagaaacatataaacggtttccggcgctgccactttagacagcagggacaggcaggcgacggccagcgtcacgatcaaagcgttcatcggcacgccgcgtttagttgttttgccgagcgatttaaaggcttgtccttcgttcgccatggcatataggatacgcgtcgatgcaaacaggcctgagttggccactgagagcagcgcaattaagataacaaagttcataatatcggccgcatatggaataccgatttgttcaaacaccacgacaaacgggctttcgaccactcccgcctgcttccacggaatcatgccggcaatgacgatgatggagagaacgaaaaagacaagggttctccataccgtctgccggatagagcgcggaattgttttctcgggattttcactttctcccgcggcaaccccgatcagctccgttccctggaacgcgaagtttacggtaatcatcgtaataagcatagccttaatgccgttcggaaacaatccatcctcataaaaatgagagaagaaaggagcctgctcgccgtgtttcatgtcgatcaggccgaacatggcggcgccgcccaaaataataaacagcagaatgactaaaattttaatgccggaaaaccaaaattccgactcagcgaacgcttttgtggtaatcgcgttcaaaagaaacatcaacccgacaaacacgaggcaccacacccatacgggaacatgcggaaaccagcggagcatcaattgtcccgcagataaaaactcaatggcgcatgtcaccgcccagccgagccagtacagccagccgaatgcgaaaccgaaagcggggctgatgaatttggttgcgtacgtctgaaacgaccctgatacgggaagggcaaccgcaagctcgcctaagcagagcattgtcaaaaacataataaaaccgccgaccagataagacagaaccgcgcccagcggtcccgcctggttaattgtaaatccggtactcaggaaaaacccggtgccgatcactccgcctaatgaaatcataaacaaatggcgcgatttcattgtgcgctgaagctgattctctttttgatttgtattcactattctgcaccccttcagcaacttgtattggaaccaagccggtgctttgaaaccgatttgctgtccaaagagcctctatttgtatatgaatgttatatgaaattcattttcgtacataaagatacattatactaaaatactgtctccgcgcaaatagagtgtgctgaattttttatttgtaaattccatacaagccgagggaaagcattgccgcatcaaggttttacgcgttttgaagcacgtttgtgatcttttggatcgcccagtccaagtcttccttggaaatcattaacggcggtgcaaaacggatcacggtatcatgtgtttctttgcataaaagcccttcgcctttcagcttttcacagtacggacgggccgcttctgtcagttcaacaccgataaacaggccgcgtccgcgcacgtcttttatgatcgggttatcaattttctcaagctcttctttaaaataccggccaagctgaagggaacgctctgccagcccttcttcctcaaggacttcaagagatgcgagcgataccgcgcaagcgagcgggtttccgccgaatgtcgagccgtgggaacccgggttaaacacgccgagaatgtcacggttcgccgcgatgcacgaaatcgggaagacgcccccgccgagcgctttgcctaagataaacatatccggtacgatattttcccagtcaaccgcgaatgttttccctgtgcggccgagtcccgtctgaatttcatcagcgatcagaagcacattttcttccttacaaatagcggccgcttcttgtaaaaatccttccggcggaatgacgatgcccgcttctccctgaatcggttcgaataagaaagcggctgtgttcggcgtgatcgcccggcgcagcgcttctgcgtctccgtatggaattaattttatacccggaagcataggtccgaaaccgcgtttatactcatcttctgaagaaagggataccgcaagcatcgttctgccgtggaagttgccgatacacgcaatgatttccgcctgattatccgctactcctttgacctcatatgcccagcgtctcgccgctttgacagcggattcaacggcttccgcccccgtattcatcggcagaatcatatcttttccggtcagcttggctgttttctcataaaacgggccgagctgatcattatggaacgcgcgtgacgtcagagtgattttatccgcctgatccttcagcgcctgaatgatcttcggatgtctgtgcccctggttcaccgcggaataagcactcagcatatccatatattgattgccttcagggtcttttacccaaacaccctgcgcttcggaaataacaatcggcagaggatgatagttgttcgcgccgtaatgtgaagtttggctgataatttcttgagattttgtgaaagctgacataatctgattcccccttgttttgtaatcattcaacattagatcttgctttccctttttataaagcaagttccgtgccaatccgaaaaaacgggatgtttcgccagcattctttcttttcctgcaaaatattccggcagtttgcgtgcaaacttcagccaagcgcaaaatttttttgcgtttcctgctgacaaaataggagcaatccaattagattgctcctattcaacaattatttatttaattgtctctgatatacaatgtaagaatataataaacataatatgatacagccgattgccgcaatgaaaatgactgacactctatataccggcggcaaaaaagctgcaagcatcatgagtatgcccgctaagacaaaaattttcgaactaaccctgtgtgtatccttccaaactctttcactgctcagcgtccaaggtgttcttatccctaaaaagaaattaggcttcacgatctgaatgaagtttccaaataccatgaaaatgactcccactataaagtttcctaaataagatatagggagatcatatcccaggccggtcaagatggtcatcagattaatgacaaacagaaccgcaaacattgtattaaatatagccatatatggccggataaatgttttgtagttatttttaggatcaatcttagggatgataaccattaaaatatatacaataatcatgatgccaataagcatcatcatcgcatcagctttcgtttggtaatcatttgcacttccgtttaatccccagtgtgtcgccaaattgtccggtaaagatgaataagtgcaaacccatgtgaaaacagttaaaacaatgattcctgccgaaaagagatattttttcatgattccccgcctttcttattatcatgttctgaatcagtcagagaaaagaaccagcctataagatcctgtaatacagtggtatttaatgaatacataataaattggcccttcctctcatcgtgaaccagatcagtatttttcaatatggtaagatgatgagaaatactgggttttgacatgtcgaagtgttccgcaatttcaccagctgtcatgtcttgtttctttaataagtccaaaattcttctccttgtaggatcggccagtgctttaaaagctttattcaaaaactttccccctctcatacgtacatgatttagatatttaagtatatatctaaatatcaatcatttccctaaaaaagtcaatgattttattacctcaatttccatttattttaaacatcgtccaagcgcaaaatttttttgcgtttcctgttcgatttattttaaaataatgaatgttaagacgattgagagggggaattgacctgcacacaaccagcgaattttacacactcgtgttacaaagcattctggaagagattgatgtcgggctgcatgtggtggacgaaaagggcagcaccgtcatttacaataagaaaatgatgcagattgaagatatggatgaacgggacgtcctgcataaaaacctgactgatgtatttatgttttccaatcagcaggacagcacgctcgttcaggcccttcaagaaggcaaaacgattaaaaatgtaaagcagagctatttcaataacaaaggccaggaaatcacgacgatcaaccacaccttcccgattgtgcaaaacggcgagatcaagggcgccgtggaaatcgccaaggacgtcaccaagctcgaacggctgatcagggagaacatgcacagaaaagaacagaacagctacacgtttgacagcattctcggcaacagcccggtcattcgggaagtcatcgaaaacgcgaaacgggcaacccgtacgtcatcgtccgtgcttttggccggcgagacgggaacaggcaaggagctgttcgcccaaagcattcacaacggcagccagcgctcaggcgccccgttcatctcacaaaactgcgccgccctgccggacagtctggtcgaaagtattttattcggcacgaaaaaaggcgcctttaccggagccatcgaccagcccggcttatttgagcaggcgcagggaggcaccctgctcctcgatgagatcaactctctcaatctcagcctgcaggcaaaactgctccgcgcccttcaggaaaagaaaatcaggcgcatcggatcagctcaggacaaaccgattgacgtccgtatcatcgccacgatgaatgaagacccgatcaccgccatttcagaagagcggctgcgcaaagatttatactaccgcttaagcgttgtcacgctgatcattcccccgctccgggagcgcaaggaagacattctgcctctggccgaagtgtttattcagaaaaacaaccacctgtttcaaatgcatgttgattcgatcagtgacgatgtgcagcaatttttcctggagtatgactggccgggcaacatccgcgagcttgaacatatgattgaaggcgccatgaactttatgacggatgaaacgacgattacggcggcccacctgccttaccaataccggatgaaaatcaaacccgctgacacggaaagcaaagcagccgcaagcacccagcccggcacagatttaaaagacaaaatggaaaacttcgaaaaatacatgatcgaaaaaaccctgagaaaacaaggcaataacatatccaaaacggcaaacgagctcggaatcagcaggcagagcctgcaataccgtctgaaaaaattcggtctggaccggatgaaatgaatccatacaaaaaaaggctgaggtgctcctcagcctttcgtttatatctgattggcaagccgctctccggtaaaccaaaagttctcactcactgccaatgtatgttccgtattctcgacttgatgccaccaatggcgcggcgcgtaaatgatttctcccgccttttgcctgaagcggatcggagacgccttttgcgccagcggtttttgctctatatctttttcatcaaagacattgatatttccttcgtacaaatacggagagtcgtccggatgatagaaaatccattccttctccccgaaaatgacgccgttccacgcgtgcgtgctgttaaaatcctgatgcagcggcgtgcctgtctgcttagaaccgagaaagaaccatttccagtcccgtcccgtttcttcatccgctctcaatgtgtcttttgtaaaatactcgggtgcggaatagacaaggtctaagtcattttggttcagctgcgtaaaattccagtcacagtaccatttgtcatcattctgatcaatgtactcgatatagttggaaagctttacttgtttaaacgttttgaccccttcgatatctgatttccggatggtgaccattctgtctccatagtgttcgtcaatgtattcaagcgtccacggcctgcattcccagtgatccattgcccccgtcaaaataaaaggtttcttatcagcatactcgcttacaaaaagatcgtacgataactcattgattgtcagtctgtcaatggtcatatccattccccttttattcggcaatctgccgttttttttgtttggcgtaactgtatggacctgaaaagatggtgacgttttgattctcaagccagaaaatcttgttgaacttctccagcaggtttctgtcgtgagaaacgcagatgatggtgccttgaaactgcatcaggctgttttcgagaatttcctgagattcaatatccaagtggttggtcggctcatccaggatcaggacattcagctttttttccattaagatggacagcttcagcctgattctctcaccgcccgacaggacggaaagttttttaaagaccgacgacccgtaaaatccgtacttggccagcatattccgggccatgccctcttcagtcagcagattttctttaaagaattgcagaatcgtctgactcgaatctccgacgtggctcttttgatcaatgtagcctattttaagattttcccccactttaatggtgccgtccgacagttctctttccccgatgatgcagcggatcagcgttgttttgccgacgccgtttctgccgacgatgccgattctgtctttatgctttatacgcagattcacattttgatataaaagggaagatccgttggccacctttccgttttcaatgaacacaatatcttttgaaccggcgcccgcttcctgaaatgcgttttttaatttttgctccgtccggaccggcttattgatcagctcgatccttttcagcgccttttccatattattcgcgcgtctgtgcagcccgacagacggcggattcgagcggttggcccaatctctcagctgggcgatggattccttcatcttctgtatttttctctgctgttcttcatatttctcaaactgggcgatgatgaattcttcccgctttttcaggtattcgctgaaaccgtaaggccaaatcttcacctcggtatcgtcaatctcgagcactttcatcgccgtctggtcggcaaacgttttatcgtgggtcgtaaacagaatggttttattcgattttttaataaacccttcaagccactcaatcgcatgaacatccaaatggttggtcggctcgtccagcagtataatgtcgtcgttgcggattaaaatttcggcaaggccggcttttgttttttcgccgccgctcagctttgaaaacggctgatcctttaattcgctgaggctgagcccgttgcatacctcgtcaatcatcgcatgcatctggtagccgttgttccgctcaaatgtttccgtgtattgactgtacttttccaataaagcagtcagctcgtcctcacccatcggttccgaaagcttcagctcaatggccttcatttccttctggatcgccgcgagagcttcaaacgatttttccagatattgatacaatgtcagatcctcatggggatcagcgatctgcttcagcaaaccgaccttcgcccctttgttgatcgcaatcgttccttcatccgcctcaagctccccggaaagcaccctgaacagcgtgcttttgccggaaccgttcggcccggccacaagcactttttcgccttcattgatgaagaaagaaacttgtttgaaaatggtatctcccgctaaatttaccgtaagattatgaatattcagcaactcacatcatccctttgtcattctggttcaaagctcgactttattctggatggcgacgctcgctttcagtttgtaaaagctgagcatcataaacagcgacaataagatggataataccccgattgcggtcagcagcaaagctgaatcaaaatagtccgttaagaatccgataaacggaaaggcaatgaacatgaagagcgaggtcatcaaactgataatggacagcagcgtggctctcgttctggacggaatctcattattcaccacctgactggatacgggttctatcacatcatagagcgcgttgatgacaacaaaagctgcaatcgtcacgtacagactgcccgaaggtataaacagataggccgccccgataatgcagaatgtcagcagaagcacgcgcctcggcgtgaatttttccgccggctttgaagaaaagatggagcacagcgcctgcaagatggacagccccgcaaaaataatggatatattgcgcacggacagcccttcctgacttaacagatcttgtccgtacatataaaaaaccgatgtaatcgcaaagaaaacggagagtgacagcaccaaatatttaaaggctttgttcagcctgaagaaatctttgacttcttttaagatgtccccgaccgtctgcgtttcgtgttcactgttttcaaatttgatttccgtcagctgtgtaatgaccgccatcgcaatcagctgggtcacaatcccggcgataaacacatacgaccatgatatttcctgcaagtagccgccgatgcccatggcgatcgcaagaccgagtatgacaagtccgttataatttccgatggatttgccgtaccacttttctttcccttgttctttcagtgaatcaaacaaaaaggcgtgatccgttcctgatataaacgtcagcccgataccgtatataatatgagcgatgaagagggcgatgaagttatgaaagctcaggaacatcaccaaatagacaatgaccataaaatgaccgagcaagagcgatttttttctcccgattctgtccgagatgacgccgctcggcacttccgccagaaacatcgccaaattcaggaccgattgcaggatgcccactagaaacaatgaataattcatgcttgttaaatataaaatccaaattccccgttcgaaaaagaagtttccgaaaaaaccggagaagtaaagcaaatttcgattccgcaaatgaatacccctttccagctatctgcatttaacatcatgaacagaaaggagcccgtcagtctttacactaaaaccctctatacatggatcttgcagatacagacttttcccaaaacaaattgggcaataatgagttgtattctcgaataacccaaaaagttccttctttttttcagatcctatggcatcaatgatcgtttttttcttccccggatcgctgatgtcgcgaatgaaatatttgatatagctcagctcatgcatgtaagccggcaggaacaaatggagctcaatatcaaacccgcttttatccatatggtaataatcattgaaatgactgacgcgggagacggatacgtccgctccggccctccgaaacaattcagccagcctttcaatgatctctccgttgggataataatcggcataaacaattcggatcggctcttcttttgtcaaaaggggcggatctttctgcggtgtccgcccgctttcccatataccgatcagtgaatcagtcggtgtgatgatatgccccaaatccccggccagcttttgtttatcaaaataatgctgaatgaaagttctcagcatgtcatcctttaccttgaaggtaaataacataggcaaatgattttctttaaaatcagcatattgccgatacctcatgttggaatgatgaaactgggtgtggcaggtcacatcggtctgattcgcttcgtacagcccgatgcttttttccagatcatcattcaaaataaattggatgatctgaacggtgcggtcatccgcgggcgtcattttatattgcggattccgctcaaattccagtcccttctcaaacgtacgcttgaatcggtacgggccgttttccggcacatcgcccccggcggtcgtcggaatcagaaagctgctctgcaaaacggcttctatttcatcagacggctcgtccaaggtgatttcaaagcgtttttcgcccgttacgttcaccccgagctgatcggatgagacgaggccttttacatacggaacggcctgttttatgttcaggaaactgccgagatggggactttggttttctttcgtcagatgatagatgatggtttgaaccacaccctcggcgtcacctaaatagtccgggtgaatgtccacctgacaggtgcggcgatctttgcggatgattcggcagttatagccgtccttcaggctttcatacataatgctgcaaatcatcttgcttgtgtaatcctgcgtatctaatgggttcaagcgtatcgggcttgtgtcgatttctattttcagaggttcgcccggttttctcgccgtacgatgcatcgtcttcataaagcgctttccttttgagaaagcttcgtttctgtaatatgaagtccgtcaaagtccaggccgatgcgggtattcagggatttcgggcttccgcctgcaaggtatgtgataatgtcatgagacataaacgaggatataataccgtttgtcgctcctaacgaacctttgatcggttcatcggggtaacagttcagaagtccggccggcatgtttttttcataggtgacgccggattgataggattcaggcgtgagcagaggcccccattggccgctgaagctgccgacacccccggtcataaacgcgatattccgctccttacaatactgataaacccattcagaaatgttatggggtttgtcagcggcatttatgacgatatcaatttcgtacggatctaacacacgcaggtcctgcggctgtgtcatttcctgatggtaaagtgctgcgtccgcatggggattgatacccgcgatataatctctgcattctgagatctttaatttgcctacagaagattgagtatagacgaattgtctgttcaggttatgtactgatacggcatcgaaatcaatgagaataaaatgctgcatgcccgccgccaaaaggttttgaagaatgatcgttccgacgccccccagacccacgatcgctgccctgctgccgtctaatctgttttggatcagattagggttttggttgtatttctcaaaatggtacagctgcttttcagtgatgcagccttcacggccgttttgccatggctctattaaagcatccaatttcattaacgcatcgaaaaactggtttcccgcttcctctcccagaagatcagaaagctcttgtttttcacagccggtgatcagccgttcaaccgcctctttgatctcactcgtatgcgcaagcttaatcgcctttcgatattgaatgataatatgccccgtgtaggtcagcacctgcacgctgtctttaaacttccagcgcttacagtccgttgacatcatgacataccccctgaaagataataactccccaaaaaggggagtcacggctttactagcagcgatgcaccaagcttgctgtttctgtatcaagatcaagttcttcaatcttcatcagtacacaccccctttgccaataactagatattatcatcaatattggaaaaggacaagttattttttgaaaatttagaatttatatataaattgtgatatttcttccgctatcccggtttaccccggcagccggatgatgaacacggagccttttccctgctcacttttcacttcaattgttccgttatggctgtcgataatggtttttgtaatggcaagacccagccccgcgccgccggattgacgggatcgggaggtttccgtcctgtaaaaccggtcaaacacatgaggcacatgctccggagcgattcccgttccgttatccgcaatcataagcatgattcctccgtcttcctgcagggagacggtgatgacacccgtgtcttcatccgtatgctgcaccgcattgtaaaagagattgagaatggcctgcttcattttgtctttgtcaaaaacagcttctatcttttgatcaacaaagaactcgagtttccggtttctcgcgagcagcttcagctcagcctccatttccaaaatgacgtctcccaatgccccttttttcatttcaaagctcggctcccggtcaatcttcgcgagaaacaaaagatcctttatcagtttattcgccctgacggattccgcgtacatgctttgaagcgctttttctttctgctccggcttttccgccgctccgcgcattaaaatttcgataaagccgtgaatggaggtaagcggcgttctcagctcatgtgatgcgtctgatacaaaccgccggatgcgcgccttcgcttctttttccgcctgaaacgcagtttcaatccgttccagcatctgattgatggagatgcccaatgactcaatttcggcctgcttcctatcaatcggcagccgtttatcgagactgccggcatgaatgtcacccatcatatgcacaatgcgggacagcggcttgagtgtgagccggatcaccggcaaaaaaacaaacagtccgataaccaaagccgcaaaggaaagtatcgcgaaaatgctgatctggcggaaaagcgaatcattcagaggctgggtcagcgtgctcatctgtacaactcccgcctgccttccgtcaacggaaatcgcctgaaacacgacgatgatttcctcacccgccttattgtgagccacctgatagtgaagcgccattgtatctgtcagcgcatcctgatacacgtttttcgggaaagaaggagcggctcccgcgtgcgggtcttctgataaaactgacatcttgtatgattgattgataaaagcaaccgtcaccccgggataaatcacattcggatgagccggtgtttcggaacgggcaggggttttgattgacctccatacgctttgatccattgaattgatatcactctgaatgctgatcgcctgattttcatacatcgtccgtctcataaacatgtactgtgtgccgccgatgaaacataacagcaaggtcaaaatcgccagtgacctgaacaggagctggaaccgcagggttctgtacagccgtttcatgccaggtccaccctgtacccgccgtcccgaaccgtgcgaatcaccttgtgttctttgtccttcagcttttcgcgcaaagaacgaatgtatgtctcgacgatattgtcttccccgagaaccgttccgtgatgaagccccatcgttaaagaatcaatgagtgcagactcgccgtctgcactcagcagcttgatgcctttcaacttattcatgatgcagtctctccttagatgtatcagcctgtgtttatttttttcgcttccccttctattattcgcttttatctgaaacaaaacggaagctaagctgaattggtgaaagtaaacgctgaaaacggagccatctgcaaataagctgccggcagtttcatctgccgctattcagcagcaccagtctgtttcaatcacaaagttctgttgtgacccgcgttcagttcttttttatagcttctgaaaaaaggcataaaaaaaagcgcccctgaaaaaggacgtttaatatgacatgtttcattttcttaaattctgcattctaaaataattcttccttcacattcaccctcgatttcattcaatacgatgatcacatcagccgttttcatgtgtttcacctccctgcttcacaatagtataatattaacaaataaatcaataaaaaacagcccggatgtccgggctgcttttttatttctgtaatcgatccgcttctgtcagtttgacttccgctgtttttttctttcccgaacggtagaacgtgatgttcacacggtcgccgatctttttgcgatacaggcgctcacggagatccacaacgtcattgaccttatgtccgtcgaacccggtaatcacgtcgagctttttcaaacccgcttttccggccggtgaaaacgcgtcgacacccataatgaccgccccggttttaacgcctttcggaagtttcagcgtctggctccaatggtagctcgcaatatccgttaaggatttcatctcaataccgaggaaaggccgtcggacttctccgtatttttctaaatcctgaataacgggaatgacaagctttgacgggatggacaggccgattccttcaacggcggattcagcgatcttcattgagttgatgccgaccaccttgcccgaaatatccatcaaagcgccgccgctgttgccgggattaatcgcggcgtcggtctgcagcacttccgcattccaatccggatgtccgtcgccgtttgagtcaacgggcaccgctctttccgtgcctgaaatgatcccctgtgtcactgatcccgcaaattcaagtccgagcggatttccgatcgcaatgaccggttctccgactttgacttgatcagaattgccgaactgggcggccgatttgattttatcagacttcaccttcagtaccgcgagatccatcagacggtcgctcccgatcagctcagcaggcacgcgtgagccatccttcaggctgatctcaatctcagtcgcaccttcaatgacatggtgattggttacgatataagaagtgtttccgttctttttgtaaatgacgcccgacccgcttcccgcttcgccgccctctccccaaatatcggtcttttggatattgagaacgccgactaccgaatccgatacacggctgaccatattcgtgacagcgtcattgacatttacgttgactgttttcacctgttcgctgccgagacgccggctggtgcttttgctgctgtctccatggtctccgcctgtccagtacggcagcaggaaagccatgagcgcggccccgacgatgacgccgatcagacttgatagaaagtatcctctcttgctgcggcggggctgttcggaggcgtactgttcatcatcgcgattataatccaccctatctcaaatcctttcaagagtactcgatttgcttatagtgtgggtcagatcgcggattaataatcatgattcatttggaaaaattacacggcgcacagcggcgtcggaattttcggatcggtatcaaataactgaaacgtttcccccgcgacaaatcctttcgcagccaatgtctgctgcacggacattctcgccagttccttcatattgttgtcttggctcagatgcgccaaatagatgcgcgatgtgccgtcgccgatgacatcagtcatggcgagcgccgcatcttcattcgagacgtggccgacatcgcttaaaatccgccgcttaatgctccaagggtatctgcccatttgcagcatgccgacgtcatggttgctttcaaacacaaacacattggccgaacggatgatgcctttcattctgtcgctcacatatccggtgtccgtcatcagcgcgagctttctgccttggtagtggaaaacataaaacatcggctcggccgcgtcatgagagacgccgaatgactcaacatcaagcccgccgaaagatttcacgctttccatcgggaacaaaaacttttgtccggtatcaagcttgccgatctgattctccatcgctttccacgtcttttcattggcgtagacgggtagaccgtactttctcgcaatgacgccgagccctttaatatggtcgctgtgctcgtgagtgacaaagatgccgtcgacgtcgtctatcttgcggccgattctctccatcagcccgtccatcgctttaccgctcaggccggcatccaccagaaaagaatgctcctctgtctccagataaaacgcgtttccggtactcccgctcgcaagcacgctaaattgcaagcccattgtgtctcactccattatttattttgattgttatcaatgactgtgctttccaatgcattcacagtgtacgtttgctgtgtctttttcttcgtcccttttgacttatcttcaattgtaattctccataccggcgccagcacctgcgtacttgtcagcgggtattgggcaatatagccgaacttgacgcttttaacggcgcaattcgcttttaagtaattttgagaatacaataattcgaccgcatcaagctcaggaatcaggctctcggtctggattcgcttgaatgactccagcatggtctgctcgtaggatacgacctggtttttatcgttcagatgcagaatcacctgtccgatcgcatccgtggacgagtcaaaatcctgataaataaactgtccgtcatatgtctggtaaaaaatgatctgtttttgatccttgtcgactttccacagtttatatttttcaccgccggttactttagaactgacgagcgattccgcatcctcctgcggtttttgcttcgataaaccgaccggatcggtaaatttcattttcagcgttgtgaccttatgatcatccgccggcatttccattaacggcttttgatccttcaaagcatcaatatcttcagcggtaaataccttttggcccgccgtcagccggtagcccgtcgcggaatcagaagacaggttgccgaatgtgatatggtccatctccatgtctttttccacgtttgaatttttaatcacttcgtattcactgctcgagcgtttttcaaaaaactgatagccgagaaaaatatcgaggatgaggaaggcaatgatgaagatcgtttttgtcttattccactccattatcgtcctcctccttccccagcagatctttcgtaatcgggacgatcttcccgttgatcttcatactccagacgggttccagttcaacgagatcattcgttgaagaagagaccatttgataggacaggaagatctggtcgattttgttcacgtcgtatttatcctgctgctccagcagagacacaacctcattgccgttcatcatttttacgtcttttgttttaatcggattcggcccgagaacatagttcggccgcttgtagctgagaacctcgtcattggcccattgcagggtcaaaacaggtccggatccgaaaggcttagacgtgctgttgatcacaggcatttggtctttaaacatgtagaaactcaactgctggttatcactcacattgaaaaattgataatgatccgtccagcttcccgtatcctctaaatatttatagcttttcttaatcagctcacccgtttggtaagaagcgctttgtgccaaattccgatgctggaattgaatctgccgctgtgtcgaattgatttccagacggctgattccgtcagtcagcacattccgattgtaattcgggtcctctctgaccgtgctcggatcattaaaaagcgtctgcttaaacaggttcgtcttaatggtttcagtgataaattctttttccttcatattaaaccgcgcattcggcatgagaaattctttgctttttccgaccgaatagaggtggtataacggcatactcgactttttgctgtacagctcattcatcagattgcggtaattcgccgattccacagtcacttccaaaatcagctgcttgctgtacgagaccatgtaaatcttcttattcatcttattctcattaaacggaataacaatatggtcaaatgagctgtattccattgacggatttgaccatttaaacatcgattggaagaaatcaatcggaatggtgtcattgaattgcagatcgagctttgccgaattgccgtttctgccgtaaagccaatttttaaaaccgagcttgtcgtattgatcggaaatatccttcatcccttttacttcccattgcggcaaatccgcccacaggtcattaaagagcgtctcatcatccactttataatgagagccgtttgtatgaataaacatatcccggggttttaccgtttgcgacactttttggctcgttttatcaattttatgcttttcccggacagtcgatttggttgaggccgtgccttctgaaaaattgggctggaatgtccaaattccccatgttaaaacaagactaatgacgaccagcactgacagtatgactgtttttatattttcacgcctcatcccaatcatcctcttgctcttctttatatggaagagtaaatgtaatcttcgttcctttgccttctacactgtcggcccaaatgtctccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacgctgatataaagcagctcttctttctcgttcacatcgactgagaaagtgacatgcccgccttccggtgagtatttcagtgcgttagaaatgatattatcgagaacctgcgtcactttatcctgatcaatctccacgtacagatttctgtccggaagctcgcggataaattcaacatgctgttctttcgtcatttcaaaacgatcgataatcagtgacataaagcggatcatatgaatccactcccgattaaactgataatctttgctgtcgaatttagaaagctgaagcaggtcgttcaccaatctgatcatgcgctcagtctcattttgggtcaccattaagaaacgcggagcgatatctttgttttcccacgcgccctctgcaagcgcctctaaatagcttcgcatggtcgtcagcggtgtccgcagctcatgagacacgttggcaacgaactctctgcgttcccgatcgagtttttcctgttcggtgacatcataaagaaccgcgattaaaccgtcgatttttccgtgctctctctgaataacggaaaaattcacccgcagtacagtcgtttcatcgtcacgttcgatctccagcagcattgaatcctgctgttctactaaatcctcaaatgtaaagttctcttttatgcccaataaagacgtaatcggcatctctaaagccgtttcacgtgaaacattcagcagctcaagcgcagggctgtttaaaagaataatagccccgttgcgattcgtagcgatgacaccgtccgtcatatacgcgataacggaagaaagctttcttctctccccttccgtcatggcttgggcatcttcaagctctctcgtcagatggttgaatgtcgttgcgagctgaccgatttcatcatgcccgtatttccgcacctttctggaaaaattcccttttgccagttccatcgcctgcttacgcatatccgacagcggatgggtgatggtgcgggcgagaaatataccgagaagagccgtcagaacaagggctaagcctgttcctgaagcaagaatcgagttgacggttttcatctggttaaaggtatcttccatactggccacgacataaatcgcgccgacaacttcctgattctctgtgacgacaggttttgctgaaatcagcactctgtttttgcttttaggatcataatatttttttgaataggcctgttttgttgagaaaatccgtttaaaaatcgggtcagtcgtctgtttccccgctatttcctcgccataaggcctcgaagaaccgacgacctcatagcttttatcaacaaatgtaatctcccgtatttcattgtttttcgtaaaatcattcaaaatccgtttgacgtcatctttaatgacggtgctgtcattatctcctttatattcctgctcaatataataggatagattgtcaatccgctgatttaacgataattcataggacttgagaagagaattctccacctgtttcacaaagtacacgccgataatctgcatggcgatgataatgagaagcacatagatcagcgtgatcttaaactgaatcgaccgaaaaaaaccaaccttattcatcgccggttagtcctgttcaggatttctcaagtaataaccgacaccccgtcttgtgacgatccagttcggatggctcggattatcctcgattttctcacggagacggcgcactgttacatccaccgttctcacgtcaccgaaatagtcatagccccacacagtctgcagcagatgctcacgggtcatgacctgtccgatatgtttggctaagtaatgaagcaattcaaactcacgatgagtcagctcgatcgtttcttctctttttgatacgacataagcgtcagggaagatgacgagagaaccgatatgaatgtcattagaagctgattcttcctcagccggcgcaaccgtaagctggcggcgcaggttcgctttgacgcgggccagaagctcacgcgtgctgaaaggcttcgtgacatagtcatccgctccgatttcaagcccgatgaccttgtcaatctccgagtcttttgccgtcagcataataatcggcatatcatattttttccggacttcccggcacacttcaactccgtctttattcggaagcataatatctaaaagaattaaatcaggctgaagctcctccaccatttccacggcttcgtttccatcgtacgcacaatgcacgtcatagccttcttttcttaaattaaactctaatatatctgcaatcggtttttcatcatcgactacaaggattttcttatccatcatcttgattttcctcctgccagaatgacttcatttcatctattgatgtttcatgatgatcacaattcggatcatgaaaaacgttccccgtctattataacggtttcaggtcaaaagataaaaaaattaaagagaacagcgcaaaaacgtattgaactgccatccttttgtcatgttttttattttcttttaaaaaataatatttttttgaaacctcaagaaaaaaaacgccgtctagtgtttgacgtcttcttctgggccggctgaaaagccggctctcccttttttataacaaaagaaaaaacgcacctactattgcagatgcgtttgggtaagtggctcgggacggaatcgaa

SEQ ID NO: 111 - DNA, 161406 bp, Bacillus velezensis FL50S
gagccggctcccttggcgtttcgctttcatctcacttcataatgcaactccgcaaattgtttgtaacgcctgacatcagtcagcttcagtcctgtctcccggtctccgggtttaaacaaagaaattccgcggccgagcagaacgggggcgatctgaatgataaactcatcgacaagtttttcctccaaaaccgggtgcagcagatcactcccgccgacaatccaaatccgcttgccttcttggcgtttcaatgcatttataaaatcggcaggctcttcatgaataaaccgcacatgttcagtacgcccggtcaatgtccgcgaaaacacatagcattctttacctttgtacggaaattcctcaggcaataaaaccaatatttcctcgtatgtttttctgcccataatgatcgtatcgacagattcatagaaagcttcataatcggtgctgtcttcaccttcagttccgattaaccaatctaaagaatgattttcccgcgcaagatagccatctgcgctgacagctccgtaaaaaacgagctttctttgaccgctcataaaaatccctccccttttttattataccttaaacatgcgggtgaaatgaaaaatgatagaatcgggtaaaaaccgccgttaccgggttttcgtttcttcctgctttggagatgctgttaatatgccgtctatccatcttccggtaatcggcataaagaaatgaaggatgatcccgcctaaacaaacggttaataacgttccgatgcctaccggaccttttagcatcaaggccagtatgaaaaatatgaagtaaatgaccgttcttgaaaaaaagatgcttctcccggttaaatcacggacaattagcgttaaccgatcaaccgggatcggtgcgaaatttgtgtgcagataggttgcggttcctatccctatcacaactaaaccgattgcaaaacagcccgcctttccgtaccatagttcaggcgttatgactcgatgcagaaaaaaaagccacatatcaatcccgattcccgttatgaacgccgtaatcatccctgaaaattccggtctttgcctttttaacattgaattacagcaaattaacaggaaagcgatgatgatttcccagcttcccacggtaagccctgcatggacggacaatcccacaataagcgcatcaaaaggcgatgttccaagatctgattgaatcgtgacagaaataccaaaggtcaagatcatgattcctaaaacataaaaaacatatttcactttatcgtcctcattttcttattttatgttgcaaatacaacaaaattacggtatgtttactatacggtattttcattgcaaatacaacaaaattcagctgatatgataaatgaagaaaggagctgtatgaccatgagtattcaattaaaaaagtgcagccttaacgatataacagagctccgggagataagcattgaaacattcaatgatacatttaaagatcaaaattcacctgaaaatatgaaagcttatttggaaaatgcattccgctctgaacagctgaaaaaggaattatccaatccgtcttctcaattctattttgtttattatcatcatgaccttgcggggtatgtaaaagtcaacatgaacgaagcacagtcagaaaaaatgggggaagattctcttgagattgagagaatttatataagaaaaagccatcagaaacacgggcttggcaaatatctgctgaatgaagctgtgaaaatcgcaacagcacacaataaaaagaacatctggctgggcgtatgggaaaaaaacgaaaatgcaatcgccttttatcaaaaaatggggtttgtccaaaccggagaacactctttttatatgggggatgataaacaagtcgactttatcatgaccaaaaccctctcgtaaaaggatacaaaaaacccggccaagctgccgggttttttctcttattttaattttcccgcacggatatcatcggtcattccttcgtacggcgcttctgaaatcaatgtttcgttattgattcccgcattgttaagatacgtaatatccgcaaactcgggaacgacatatttcgggtacgtttcatatttctcacgtgactctttcatcacgtcaatgtaatcattttggtagcacaccgtgatttccggatgctcatgcacccatttcgggaagaaaataattccgtgcatccgtttttcattcggcataaagtttaaggaaacgtctgtgcctgtcggttcagtccatgacactttgtatacgccttctgtcagcttgacgatattcacttcctggtcgcgcacccaacggccgcctaccattccgctatgaatccgatagtcgatcgtatgatcatttttaatatagatttcatactcccagccgttttcatacgtgtaaatcatatggcttccgataaagttttccatgttgactcactctccatcttattattgaatttcataaatatctaaccgaatgtcatccggcaatctgaccgcagccccgataaacagccggtcctgcagatgctgatatgcctcactgcttgtttcaaacacaggcacagtgcggaaatacacgtgctcgggatcaatgatgcgtttcactgactcataaatgacttttttaaagaaggttcattcaaggacgtatcacctcccgagacattatgtttgtttaaacatgtaactatttacataattaattgtaacgctgttaaaatggactgtcaaataatgagctgtttccggttatgttttacagtgttcaataaaaaaagacaagggcggcacatgccgaaacccttgtctttttcattaagcttatctataaaaaacgcagacgagcgtcttcttattaatcacaatctttatctctgcattctttcttacttacagcgtctattgagtgccccatgatcttgtcattggccttatcgtaaataccatcgaatttattcgatgtatcaccgttgtaatagccaaatacctctatcccgcccattggatctatctcgtatttatctttaaatgtaacgttatgtataccttcataattcgctttgataaatttctccattcgttcttgcgcaatctttatctcttcagcctgaacatttttatcattcatactcttcattataaaacctccagctgctattaagataatgaagataataatatattttttcacagaatcatccgtcccatcagttatgatgaagctcgcggaatggaaaaatggtggtgacatccgatgcatttagcgtcttaagatttttcttcaatgtccgcagaggatcatataagcggcaatccagagtacttctttattccagcgtctttttagtattcacattctttttcctgacattcgggtttctcttctgcatcgactgacgaaactcctatttcatcattcgttttgtcataaagtccgaaaaattctttttccttattaccattcaagtaccccttcaaggaaataccacccataggatttattttataattgttaatgtatgtaatccgctttatatttttgtaattagcttttatataactttccattttatttttcgcttggataaaaagttcttgttctgcttctttttaatcatggtggtacttcatgtagatacttcctgacgctatagttatcacaaatattagggcaattttgcatctcttcacaaactcatcctttcttagattaaatttatatcaacctcggggtgttgtacatgtctaaaaaacatcaacgtatcaagtatcagtgatcgagaatacttttttataagcgttagttatagttagatctaggttaaatgaagtgatgaaggagaaaggaattcaaatccagaaggaattggctgatttagttggttctactgaggctgcgataagcagatttaaaacaaatacaagatatgatatcacaacactattcattattaactgaggattaaatgtacctatggaagatttgttttatgtcgaggagatagagtaagagcaataaaacaaaattagctcagctcgattgagctggctaatttatcttgtacaaagcttatctttacattcttctttgggttcggcatcaaccgtatatgataatatttctttattgcctggatcatatagaccttcaaactctttttttccattcgtataacccttaatactaataccacccattggattaatatggtaatcctcggaaaaaatggatattatccacatttttatagttcattgttaaaaacttttccatatgattctgggcttcttcgaataacgcaatctctttttccttctgatcatactgatgcttcataaaaagtcccccaactgctataattattaaaataaggataattatatactttttctttttcatttggaaatcaatcccttcctataaataactgtcgttcttaagtaaacgaaatgagcgaaaacttgatatgaatatactttcagcatgtcaaaagcaaagctaaccaattcagaattcatcgcgattgttgctgacaagttaagattggaacttaaagcgagtaaaatgctgatctgacgttttcctgtcgttgagttgtcatgatatttgtacgcgtttaccgttaatatcggggatacctcgacaaatgagacggtagaggcgattgatctcaggaataggtttgaactgtatgagaaacatatcacgaattttgtaagataattaaacaaaataaatacccactcatcctgaggtgggtattttacctttcttcggcattgaccactgaaatacctatctccttgttcgttggatcatatataccggaaaattctttttctttattattatttatgtagcctgaaacttcaactccgcctgtcggatcgatattgtagtcttttgaaaagtgaacttcctgtacatttttatagtctttttttaagtaattcctcatatgatcttgcgcctcaaccacaagtttttcttcgtttttatgtttatcatattgatgcttcacgaaaaaacctcccactgctataattataacaattaggataataatgtattttctcatgcgtatcatcctttcggaactattttacaatataagaaaggtgatgtatatatgccaaaaggaaaagaaataaccgtctctgatgtcacagataaagaatattaccgtttgagtcaagcagcttacaattataaaatgttagccctgcatatgaaatataaaactccttataaaataagtaagacgtcatattggtacgttgagaaagtgaagcaggattctgatacgggtcttgatgcctttgtattctcaaaaggcatcaagtccaaaaacggaaaatgggtaaaatcaaaaaaacccgaaaacgtggtcgtcgcctttgcgggaaccgatatcggaaaagacccgatcaatgacggcgtaaaagcggacggcggcaatattgttttcggaaatgatccgcaaaaagaagtgtattatattgtaaaaaaagacgcggaggatacctcgaaaacactcggaaaatataatggaacgccctctcaagacgccatgctcacaaccggaaagtataagctgataacgaaaacatcgcaaatcgatcaagccgatcagctggtacgcagcgtaaagaaaaagtatgccggaacatcaacgattatttcaacaaccggccattcactcggcggcgctgaggccgaatacagcgcggtgaataatgatgtgtacgccgtcgcgtttaacagcccttccgtcgtaaaactgcacgatgaagaaacacagaaagacatcaacagcggtatatacgatccatacatccggtcaattatcaatccggacgacatggtcggggcgggttattggaacgaatatgaccgccacaacgggacaacgatttatacgaaaaacccctcactctcacagttcagccggaagcagcggcttgatgggaacttgaacgagcagatcggcaaaaatctcgcttatttctttactaccgtcattctgagaaatccggatacacacggcttaaatgaagcgaatttcatatttgaccgaaacggaaacatcacaaatccgaacggagatgagttagtcttcgataaaaatctcggcgctcttctgccggccggtgcgatcggaagcggagacgcgataaaagtaacgccgaaaaacgcaaagaagctggctgaaaaggtgcaggccatgactgaggatttgcggacgatgaaaaaagaagcgcagaacgcctatcaggagcacgatgaaaaaatcgccgagctgaaaacggaattttacggccaagtcggacacggcttgtttgatcagcttcaagcacaggacgtgaccaatacaattgaagatattgcgcaatcctacgataaaggaccgattttttacgacacacaggctgagcaggcgtttattgattctttgcaggcggcgatcacggaccttgaagagatcggcggattcttacataaaatagcggacgaatttcaggaaaaagaccagatgctcgcaaactggttaagatgatagaggtggatacataatgccgacattagacgaacttttagaacacaaggacgacccgatgaagaaaaggctgcagcggcagatgctgaaaactgccatgacgcaggcagcggggacaaaactggaaacagtgcgccaaacgctgaaaccgacattcgaaatggatacgttgaaagatgaattatatgaagtgtattcagcactattgaacagctttgaaggcaaggcgcaaaaagctcttgcgcagcggatcagtgaaagtgcgcggctgattgccggcaccgaacataacagagacacattcattaacagtttcaaaacaagataaaataaaaaaacctcgcagatttatcatctgcgaggtttttcctatcgtcttaactgagacgcgctcggagggattcgaacccccgacagacgtggtaccggaaaccaccgctctatccaactgagctacgagcgcacgttttttcaatcagatacctttatattataataaagaaacgcacagaaagcaactcttttttgattatacacaacaggattatgcagcgtcctcgtgcagcataatcctgcatcgtttaacggcattgattttcacaaaaacttatttcaggcggactgcccccggctcggtacatttccagccactgcagaaaaagcgataatcacccgtttcagctttttttccaaatgtcctttaacgtccaataggtgaattcctcaacctttacggcgcctttctcagaaaacagctcaatccccaatctgccttcattcggatagatacggcttgtcatcgttgtttctccatgattggcgaatacttcaatcgaggatctgtcaataaagatacgcagcgccagcttgacgtttgcatccagccgcacccttctcacaccgtctttctctttccccatcttggtgcaatcaagtgtcagctttttatccgttagattgtatgtcagcacaagttcttcttcgtcaaggccgcgaatcttaaaacctgccgtttcggcatcagaatcgtttacatcaaacacggctcggacttcaagcaggtcttcggacgtctttgccaagtaactccctgaaaccgatcgtccggcacattcccgatattccattttccgcagctgcttggtttcttccacgggattcatcaaaagtttatgatcatcacgcaaagtcagttcccgcggcaaagtcaatgcaccgcaccatccgtccgcttttgtcggcatctcagattcccacatatccatccagccgatggcaattctgcgtcctttatcatctaataatgtttgcacggcgtaaaagtcatggccgtgatccagttctttaaaagcgccgtgtgtaaatttgtttgtttcattattatagtcaccgattaaatagccggtttgatgtaaattgttatatgaatcgccgtccgcctcgataccctggggcgaaatcagcaggacatgtttgccgcctaattcaaagaaatcaggacattcccacatataaccgagattaccgtcactttgggcgagaatccccgcgtattcccaatcacgcaaatcaggtgaacggtataaaacgacccgtccgacgttttcttttgaagagttgccgatgaccatataccaaacatcgcgatgcttccatactttcggatcgcggaaatgacgggcgctatcttccggaggttccgtaataacagggttttcctgaagcttttcaaacacggttccatcttggctgacagcgatattttgagtttgatagaataggtctttctcttgatcaattatattatgtcctgtatagataagggctaatcttccatgatcatcgaccgcgcttcccgaaaaacagccgctttgatcgaattcgtcccccggagctaaggcaaccggcaggtgctcccaatgaatgagatctttactttttacatgtccccaatgcatcggcccccaatgctcatcatacggatgatgctgaaaaaagacgtggtattctcctttaaactgaataagcccgttcggatcattgatccaattcgcccgcggcataatatgataccccaatcgatatctttgtttcactttaccctcggcttccttcaaagcttcttccgcctgctgaattctgtccatttgcaacatcctctctatccgattttttgcagacactggacacgcctgctgttttgtttcgggcccaataaagtaaaaatggagatgacggtaaaaccaaagacgacgaatcccatgatgagataggtttgacggaaccccgcactgtcatataatcctcccgcaagcggcgacagaatcgacgcgcctgcctgagatgcgaattgaaaaccgacgagataaaggacggacgacagacgcgtatcaaaattggcggccaaatatttaaaaacggcgatcagcataatcggcaattccagtgcgtggatgagcttcattgatgaaatgcctacaggctcaactgcaattccggacccgacgatgcggaaagccattaaaaaccccgctaaaatcaaactgtttttcgctccgaacttattgacgataaaaggcgcaagaaacatcatgccggcctccaaaaacacctggaatgaattcagatagccgaatacttggttacccatcgacactgaaggaaacaaagacgcatagtagatcgggaactgctgatcataaacgccgtaaatgcaagtcaccccgataatgtacgtcataaaaaaccagaaatcttttaataaaaagagccgccccacatcttttaaccggaccgaatccgctctgtttttctcatgatcggtcatttctattttcacggacatgataatggccgttaatatgacggctgaaacagacgcgatccagaagttgatattgggattgatattgaaaagctgccctgcaaaaaatgcagccgccgcccagcccagcgagccccacattcttgattttccatactcgaaatcatacttacggctgaccttttcaatgtacgtttcaatcgcgcctattcccgccaaaaaagcggctcccaaatataagcctccgacaacggcgccaagaaagacgttgtattgtaaaagcggcccatagacgtagatataaaacggacccgtgaatatgagaagacagctgatcataaacaatatctttttcttcagccccaatttgtcagagataaaaccgtaaagaggctgcatgcacagggcaaatacggcgtttacagaaaagataatgcctgtcgctgatccgtttaaattgatttcctgccctaaccaaatcgcaaataaagaatagctggaagaccaagtaaaaaagaaaaagaagaaataagcactcagtttccaatacagactttttgagcttttcatttgcaccgctcctttaataggaccttttaatagtcattttgagccgcatacttccttcttcatattcatcacatacatgcgagctccgagtaagcgcttactttccgccgctgcttgattctttcactttattgccgccagccatctctccatacccgtcacttcccttcactccgtaaataaagcgctttcaaaaagaattgtatgtcaaccggtttcatatgtcaatcggttgacatatgattttctgattattccaatcaaacaaaacgcaccctctttatatgaaaacagaaacatggaatgtccttgcacatgtcagcctgattctctaaaataagtgcgtgacggaaattgtaagccatttcagtatgcaggagggcacgggaatgaagcctaacattcatgatgttgcgaaaatagcgggagtttcatctacaaccgtttcgcgggtattaaataaccgcggctatatcagcgaaaaaacaaaagaaaaagtgtacaaggcgatggaagaaatcaattactttccaaacgatctggcccgctctttattccgaaaacgaaccaatttaataggacttatcatcccaaactccagcaacccgtttttcggcgaactcgcctttcatattgaaagcatttgtacgtccatgggctacaaactgctgctttgcaacagtttacatcgaaaggataaggaagaaaaatatttggagatgctgataagaaaccaagtggacggcgtgatcgccgtgacttataaccggggaattctcaattatcacaagcagaatctgccgattgtcgccattgatcattacttatcggacacgattcccgtcgtcggctcagacaactatgacggcggaaaaaaggcggctgaactgctgattgaaaaagggtgccggcacatcgtccatctcaacggcccgattgaactcgaaacaccggcaaacctcagaagaaaagcatacgaagacgtcatgcatgaacacggacggaagcctattacatatgaagtacccttttatcagcattaccatgatattatttcaacattattcgatgaacagcctgacaccgacggaatttttgccagcgatgatatcatggcggctgccgtgatgaccgaggccaaaaaacgggggaaagacatcccgaatcaattaaaagtgatcggttatgacggcactgaaaccgttcaatcggttctgccggacttgacaaccatccagcagccgatcgaattgatttccaaaacagccatcgagattttagcaaaagaaattgaaggcgaatttgatgatttgccgctggaaacgtatttgccggtacggcttttggaaggacggtcaacgtagtcagaccgttcagccgtatgtaccgacgcgactgcggtctattttgagcgctccggccatatcattttctcaaggctccggcgctgatcatcctcattttcactttgctgtttgaactttttgttttatgggaaaaatggtgttagaagaaaaggttggcattttggtcagcgttttgtttgacctttattgaccaaaaatgtatcatgtaaatacatacttacctaaaaggtgaaggaggagcattatgaatttaatacctacagtcattgaacaaacgaaccgcggagaaagagcttatgacatttactcccgtcttttgaaggaccgtattatcatgcttggatctgcgattgatgacaacgttgcgaactccatcgtgtcacagcttttattccttgaagcggaagaccctgaaaaagatatttccatttacattaacagccctggcggatcaatcactgccggtatggcaatctatgatacaatgcagttcattaaaccgaaagtatccacgatctgcatcggtatggccgcttctatgggagcatttttacttgcagccggagaaaaaggcaaacgttacgcgcttcctaacagtgaagttatgattcaccagccgcttggcggagcgcaaggacaggcgacagaaattgaaatcgccgcaaaacgcattctcttgcttcgcgacaaattaaacaaagtgcttgctgaacgtaccggccagccgcttgaagtcattgagcgcgatacagaccgcgacaacttcaaatcagctgatgaagctttagaatacggcttaatcgataaagtgctgacacgcaatacggaagaccagaagtaatgcccaaaaaacctgcaagagatgatgtctcttgcaggtttttttatgctttattcccattcaaaaaagtaatgaatgctttgacgacagataattctaacgctgaagaatcatacatgagccaagtatcgcgtatcacaggctcattatttttataggatagcgccaatgtgtataattcatcagaaggctgaagacagatttccggcacaacagaataaccgaggccgtttttcaccatctctttacaggtttcctgcctgtctacctccattgcaatgaaaggcggttcagtaaattggttattccaccatttttgaatcaaacttttcaaagaagcatcagtttgataataaatcatcggcaatttgggaaggtcctcactgttgatttcagtttttgaaataaggtacagcctctcttcattcagcagttgtttttctccttgccaatcataatttcccctcataatcccaaggtgtaccgccgaatgatgaagcagatccatcaccttagcactccatcccgtattgacgtggaattgaacagacggatactgatcagaaaaccgttttagaatcgccgggagcttatactgagcaaaattgcttgagactcctattctgagaaccccgctgacttcatggctcatattgagcatatcgtccttcactcttctgaactcctgcagcatctctttcgaataatcaaccagatgttcaccttctgaagtgaactccatccctttttttcttttataaaaaaggcgcactccgaattgtgcttccaggtttttgagccgataacttaacgccggctgtgtcatatataatcgctctgccgccttcgtcatatttttttcttcgaataatgtaatgagcacaatccaatccttttcatccatatgaaatcccccaaaatatttttctgctataaaattttctcctattataaaaattttttattcaactttataaaaattatatgttttacttataatccttatttatcatacgatatctcccaaagggaccggtacctttttatccacacaaaatgatgtaaggatgagacagcatggaaaaagttcctgtaaccgttatgagaggcggcaccagcaaaggcgtttttattcttcaaaaagacatgccagacgatacaaacctatggagcgattttcttttagacattatggggagccctgacgagagacaaattgacggtctcggcggcggccattctctcacaagcaaggcagccattattaagaaatccgccagaaaggatgcagatgttgagtatacgtttgctcaggtcagtctgactgacaaatttaccgacttcaaaggcaattgcggaaatatctcttctgccgtaggcccttatgctattgagaaagggctcgttcaagctgaagagccggttacaaaagtcagaattttaaatacaaacactcaaaaagtgatcgcagcagaggtcgaagtcagaaatggaacatttcattaccagggggactgctctattccgggggttccaggtacagcttctcctatttatctttcatttcaccaggctgaaggagcggtgaccggtaagctgtttcccaccggtcagcctattgatgttctcgataccccgtatggaaatatctcggtatcgattattgattacgccaatccgcttgtctttgtaaaagcagaggacacggggcttaccggcttagaacttccggatgaatataccccggatatattggaaaagctcgaaatgatccgatcgattgcagccgagaaatgcagattcgctccgagacatgaggctgctgcaaaatcaccggccgtaccaaaactgacattaatctcatctccagcggattatatcgatacaaaagggataaagagacacgcagaagagatggatcttgtcattcgtatgatgtccatgcaaaaaccgcatcaagctttagccattacaggggcggtatgtacgactgccggcgtgctattgcaagatacaatattatctgaattttcattctccgggagaacgatccgattggggcatccaagcggtattttaaaaaccgaggcagatgttgatccggatggaacaacgattaaagtagtacgcacagcaagaaaaatctctgaaggctatgtgtttactaaacaaagttacagcatgaatacgctcaatcacattggttaataccgtcttcagacaagtcaaagataaacggaggaatacgagatgatcaatgtaaatgcgtctaatcgattaaacagactgcctttttcaagggcccatcaagcagtgctcgttatcctttcattcgcttacttttttgattttatcgatttaaatacgttttcatatgcggcgccttcacttttaaaggaatggaacatatccactcatactatcgcttttattacatctgtctcctatttcggaatgtttatcggcgcctctgccggaggatggttttcagaccgtttcggaaggaaaaaaggtttaattctggttgtcacctttttctcttccttctccctcctctcttctctggcttggaacccagaaatactcggtgtttttagattttttacgagtttaggtatcggcgccacaacgattgtggcgagtacgtatatcagcgaatttttcccatccgcaactaaaggcaaataccaggcaatctgtattacaatcggcatatgcggaattcctgcggccggctgggtggctaaattggtcgtgccgtccgcctcttacggctggcggtttgtctttctattcggcgcggtcggtattttttttccgctgatcgccagaaaactggaagaatcaccgaaatggctggacacgaaaggaaaaagcgaacaagcacaccgcattctgcttgaactggaggcaaaagcagaaaatgaaaagggtgaactgcctgaaccagctccggctctgcaaagcagacaaaccgctgtaaaatccgttccatatcggaagctgtttcaaaagcctttggcaggaagaacttttgttttaatgacgatgtgggcagcttccaccattgcaattcaaggctttggcacgtgggttcccacccttctggtgaaagaaggcgtatcaatggatgagtctatcgtatacgtcactctgggaacgatcggtgccccgctgggcgctctcattgcggcgcaaatctctgaccgtgtggatcgaaagtgggccatttctgttttatcgttaattattatggcgcttggattcttttacggcatcaatcctttgccgatggtcattatcgtatgcggatttctcatgcatatgtttgagcgtactttcagttcgatcgcatatgcttatacgccggaattatatccggttgaagccagggcatctggaaatggcctcacttacggcgtaggacgtcttgcaaatgtagccggtccctttgtcgtcagtttcctgtattcaggctacggatttttaagtgttttcttattctttacaggctgctggtttctttgtgcactgacagtcggtatatttggaatcggttcaaaaaaacaaaagatgcagcaggatgatttcatatcggaagaaacattcgtgcaacaaaagttgtaaacgcatacagtctggaaaccgcaaaacatccatctcctctgaggaaatggatgttcttctttcaaccccaacagcagtctcattcgcctcttattctcagacatatctcttattacgaagaaaggcgtggtacgcatgagaaggagaaaagaactttccgtcagaatgaattagatgcagccgccgaaacatatttcagaccgctgccttacaattcacgccatttcttatctaaaatcgggtatgtataccgattcatctgctcaatcagctcatccggccgggaggaactatgtatcagctttaaatgagactcattcgaaaatccttcctggatgctgtacttgaccatcttcatcatcggctcaaaatacccgttcacattgtacagcccgatcggtttttgatgaatgccgatttgcgcccagcacagcacttcaaataactcttcatatgttccgaaaccgccgggcatggcaatgtacccgtcggcaagttcactcattttcgctttccgctcatgcatgccgctgacttcaatcagctccgtcagattctgatgaacaatctctccgctgaaaagcccgctcggcatgacgccgacagcttttccgccgcctgccattaacgcatcagcgacggttcccatcagaccgacccgtgaaccgccgtaaacaaggccgattccctgctccgccatatattcacccagttcggccgctttgcgtttgtactcttcatttacccccgggtttgaccccgcaaatacacaaatggttttcattttttcatctccacatctatatatgtacatcaataaatcaaaatacactatatattgtcccatctctatatgataatatcaataagaatcatacaggacataaggagtgtttcacatgcagatggctgaagcagaacaatggacgaaagatttttacgaaaaacgaggatggacggcgtacgggccatttatcagaatcggctttttaatggaagaagcgggtgagctcgcccgggcggtaagagcatatgaaatcggcagagaccggccggatgaaaagaacgcaacccaggctgagcgcaggcaggagctgattgaagaaatgggtgacgtcctcggaaatctggctatccttgccgataagtacgggatcacgttagaagatgcgatgaaagcccatcaggaaaaactgatcaagcgctttgaaaccgaataaaaacacggcccgtccgctttttcatggacaggccttatctgaatttatcccgttatctcgtcctgatgctcaaagaaatgctgtttcccgattttatgaaacagccccgtcttccggatcagctctctcggctgtgattgcaatccgacgatcatcaatctcccgttatgccgtttgatccggttcattacattccccagcaccgcttctgcggaggtatccatgtaatgcacattattcatcagcagaataagcgtcttcggcttttcctgaagcctctccagcagcgatgattccagtgaatcaattgaaccgaaaaacagcggcccttcaatggaatatgtgctgacggacgaatcatttttaaccgatttgaccgcggcatgcggtgttttaatgcttgttgattcgctcatttttctgataaagaaaacaaaagcgagcacaagaccggcagaaacgccgataattaaatcaaacagaaccgtcagcaaaaaggttgccgccagtacgaatgaatcagtgtttttcagccgcatcatattggcgacttccctccgctcactcatgttccaagccacaaccatcaataccggcgccatgcttgccagcggtacgtgaacggcaagcggggcgaagacgagcaggacgaggaggacggtgactccgtggacaacaccggaaatcggagaaactgcgccgtttttaatatttgttgcggtccgcgcaatcgctcccgttgccggtatgccgccgaaaagcggcgctgccatattggcgatgccctgcccgacaagctccctattgctgtcatgccgtgatcctttcatattgtccgcgaccatcgccgataatatggattcaagtccgccgagaagcgcaatgatcagagccgacggaaacatcatcaccatgttatcaattgagaaatccggaagcttgaaagccggaagctgccgcggaatttctccgtaagcagaaccgattgtcgccattttgtcaggaaaaaacacgaccgccgcggctgtagagacaagcagcgccacaagcgcgcccgggatcttcggcatcagcctggctgataacagcaaaatggccaaagcaattcccgcgatgaggatgctgtacaaattaaaggttccgatcttcttgcctatttccgcaatgttgaggataaagctttcatgcttttggatatcgcgcagaccgagaaaatgggcaatctgctccgagaaaatcagcaccgcgatcccggccgtaaatccgacgatcaccggcttcggcacgaatttcataatctttccgagcttaaatacgccaaacaggacgagcatgacgcctgccataaaaccggctacaagtaaattctcaaaaccatactgcatcacaatggcaaataaaatgggaacaaacgcccctgtaggcccgccgatctgatatttagagccgcccaacagcgaaatcagaattccggccacaataacggtgtaaagcccgtattccggaccgacccccgaggcgatggcaaaggccatccccagtggaatcgctacaattccgaccacaattcccgcgattaggtctttctgaaatttctgcaaattgtatccctgatatctgccggtaaattgcatcgtcagctgcatcctcctttgactgtttcataaccgtcaacgactacatccagcgtccccgttcccggatcgatcaccagcccgtgcaccggcacctcttcaggcaagagcggatgatgcctgaccatattcacgctgtgggccacgctttcttcgacgctgtgaaaaccggtcagccatgtttccaaatcgactcccgcatgctgcagaaggctgagacatttgtcctccaccccgcgctcttttgctttatttaatatggaagccgcatttaatcccgacattccgcactcgcggtgacctatgatgcagacttcctctgcctgcagttcataaacggcaaccaaaatgctccgcatgacacttccaaatgggtgagaaacaatggctcccgcgttttttatgattttggcatcgccgtttctgagtcccatcgcctgcggcagaagctccgtcagccttgtatccatacaggatacgatgacaagcttttttttcgggaattttgtcgtttggtaaggttcatatttcctttcttggacaaactgctggttgtgctccaaaatgcttgataaagaaaccatttttctattcatctcccatccgattgtattgcaagccttcttacccagcttacagtaaggaattatagcacagaaaaaggcctcaaaagcgctttcaaaaaaagacacgataatttgactgtaaattcagattatattcatttatatctttcaaaaataataaaatttatctttacaccaacctataaagcttttgaaaacagcggttccgctcattttgccttcagaaatataggcggattctgttattgtttggagaaatcaagcatgtacattcctttttctttcattttaagttcaaaagaaccagaaatttatcgtaatgcgtttgattatttctcacgttaccgcttctcttatataataaaatagagaagaaagacaaaggaggagaagcccgttgaaaccctatgtattcatcgcgaaaccgataccgcccgaagtcgaacaaatgatagacgagcattgccgctatgacatctggaaagaagataccattccaaaagagaaactgtacgaaaaaatgaaagatgctgaagggctgctgacatccggaacggcgattgacagtgatttgctggatcacgcgccgaagctgaaggtcgtcagcaataattcagtcggctatgataattttaatattaaagaaatgaaaaggcgcggggttgtcggcacacatacaccgtacaccttagatgacactgtcgctgatctggctttttcattaattctgtcttccgccagacgggttgccgaattggatcgattcgtccgcgccggcaaatggggaaccgttgaggaggaatctcttttcggtatggatgtccaccatcagacattaggaattatcggcatgggcagaatcggtgaacaagctgccaaacgggcaaaattcggcttcgatatggacgtgctgtattataaccgcagcagaaaaccggatgccgagaaggaactcggggttacatataccgacttagatacactgctgaaaacatcagactttgtgcttttaattaccccgcttactgacgaaacgtatcatatgatgggagagagggaatttaaattgatgaaagatacggcatgtttcgtcaatatttcccggggaaagacagttgatgagaaagcgctcatccgcgcattgcaagagggctggataaaaggcgccggtttagatgtgtttgaaaaagagccgatcgccgaagacaatccgctcctgcagctggaaaacgtcacattgcttccgcatatcgggtcagcaaccgcaaaaatccgtttgaatatgttcaagcaagccgcacagaacatgattgacgccgtatacggaaaaacaccgaaaaacctcacgaaggaatttcaatgagatgaaaaatcccggccgtttcagccggggtttatttttcactagatcaaaagtactattttaaaattctttctattcctttctcttgatgctgatacaatgaaaaggaatcagcttcacatgataaaaatgggaggtattgctttgaaaaaacgattatcgtggatttccgtttgtttgctggtgctgttctccgcggcggggatgctgttttcaacggctgccaagacggatacatcttctcacaaggcgcacactgaagcacaggttatcaacacgtttgacggggttgcggattatcttcagacctatcataagcttcctgataattacattacaaaatcagaagcacaggccctcggctgggtggcatcaaaggggaatctggcggacgtcgccccggggaaaagcatcggcggagacatcttctcaaacagggaaggcaaactccctgcaaaaagcggacggacgtggcgtgaagcggatattaactatacatcaggcttcagaaattcagaccggattctttactcaagcgactggctgatttataagacgacagaccactatcaaacctttacaaaaatgagataaacacatacaaaaaacggcttccctgcggaggccgtttttttgcagagaatctgcaagcttcatataaaatgagcagtaaatttttcttcaaactctgagcggtctattctgctgttttccgccgtgccatcgtgtttttttattgttatattgcgttcagacagaaccatgtgcccttccggtgtccgcttagaagcaagcaggcgtttgttgaaaggagaacgttcatgttcaaagattgtttgtttcatagacttgaggtccttttcatcgatttcttcaagcgaaaatgcgtagcctgtctgccagccgtcccctttgttcatttcaagcacgtatgtcccgaattccgtctcttctatcctcacgcggaacgctccggccgctgataccgtctcgtctcccgacatcggcacaggctgcatggcgagattgaggccgaagcctgcatcagcgatgtactcatttcccccggcggaaagaagtacggccgcatgtgtgccgggcagcgcccagccgtttttccagaccgttccgcggatcaatttgacatcaaatccggcatctttcaggatgaaataaagcagtccgttcaagtcataacaaagaccgccgtgaggttccttcaccatgtgccgccacagtccttctttcgtgacgtcatattcttttttggacaaaaccgcgcggttttcaaacggaaaccgatacgcgagcgcctttaaaaactccggcaggttgctgaaatcgagggaatccttttcccagcctatcgtttgataacaatctttcagaaactcattcatcgttccgtcccccttacaaagtgtttacacttcttcctgcacataagcggacaacttttccagcgcttccttttcatcgtcgccttcagcgatcagagtgacttccgtccccgtactgaccgccagactcattaatcccataatgcttttggcattcactttcttgccgtttttctcaagaaacacatctgatgcaaaacgatttgcctcctgtacaaacaatgcagcggggcgcgcctgcaatcccgtctttaaacgcacttccactttcccctgaaccataagatctccccttttctgtacggttatttcaaagtgatgctttgtcctgtacgcagctgttctgcgatttcatcgagctttctcagcctgtgattgatgccggatttgctgattttcccgcttgcaaccatttcccccagttctttcagcgtgacctcctgataatcaatccgcagctgcgcaatttcgcgaagcttttccggcagcgcttcaagaccgatccgttcatcaatgtatttaatattttccacctgtctgagagaagccccgatggttttgtttaagtttgctgtttcacaattgacgaggcggttcactgagtttctcatatctctgacaatccgcacatcttcaaagcgcagcagtgaattgtgagcgccgatgacattcagaaattcagtgattttttccgcctcttttaaatacgtaatatagccttttttccgttcaagcgttttgctgttcagatgaaaatcattcagcagggcgcataatgaatcgttatgttccttataaagcgagaagatttccaagtggtacgacgatgtttcgggattattcacagatcctcccgccaaaaacgcccctctcatataagaacgtttgcagcaccgtttcgccaccagttcttcagaaatattccgttcaaatacaaagttctccccgaggattttcaattcctctaaaatcagctttgcattttcagaaaagcgcacaatataaacattattttttttcagccgcattttttttctgactaacagttcgaccgatacatcatattgtttcttcagcaatgtataaatgcggcgggcaatcgccgcattttcggtttgaacgtcaagcacgagatggcggtttgaaaatgacagggaaccgttcatccgaatcagcgcggacagctccgccttggcgcagcagtccttcacttccagattcgtcagttctttttttgtttccgatgcaaatgacatattagccacctcatttcaaaaggcctctagtcccttaataaatcgacaagaagagaagccactttatgtgtatcgtgacggattacgccatttttatacgtgataatctgatccctgatgacctcaagccccatggatttcagcttttcaacattgaagtcgacgggccgggccagctctttcgcatatttgcttttgatttcgtcagggatctcctcattgttgattaagatcgtgtcgataaacggctgctccatatgatcgttcagcgccttgacatggtcggccgcgctgtattgaagcgtctcgccgggctgtgtcatgacgttgcatatatatacttttttggccgcggccttgacgacttcctctccgattttcggcacgagcagattcggaagaatgcttgtgtacaggcttcccggaccgataatgattaaatcggcctgacggatgacgtcaatcgtttccgggagaggatcaattttttcaggcgtaagaaatacccgtttaatccgctggccgtaagaagggattgtcgattctccggagacgacctgcccgtcctccatttcagcgtgaagaacgacactggtgttggcagcaggcagcactctgccgcggacattcagcaccttgctcatttcggtgacagcgtgaaagaaatcaccggttatatttgtcatcgctgccaaaatcaaattgccgagcgaatgtccggttaagtcgcttcctttgttgaaacggtgctgaaacagattttcaacgagcggctcaacatctgacaaagcagccagtacgttacggatgtcacccggcggcggaatttgaagttcatcccgcagacggcctgaacttccgccgtcatcagcaactgtcacaatcgccgtaatatcaacgggcttatgctttaacccccgaagcagcacggacagacccgttccgccgccgaagattgcgattttcggcttcttattcatttccggcttctcttttcaatgtcccggtgagtgacatgagtatagaaatcttttttaaaatagtcagccaaatactcagcgagcgtgacggagcggtgctggccgcccgtacagccaatcgcgatgacaagctggcttttaccttcccgcttataagacggaagcataaagccgagcagatcaacaagcttttcaataaacttttgtgtttcgttccacttcatcacataggatgacacttcttcatctttccccgtaagcggcctcatgctttcaatgtagaacggattcggcagaaaccttacatcaaacacgaggtcggcatctatcggaagcccgtatttgaaaccgaatgacatcacgttcactgtaaatgtttcaccttggttcgtggcgaaatgcgccacgattttttcacgcagatcacgcggtttcatatccgatgtgtcatagatcagctgagagcgccctttcaattcttcaagcagctggcgttccagcgcgattccttcaagaggaagcccggtagcggccagcgggtgagaacgcctcgtttctttgtatctcgtcacaaggatagaatccttagcgtctaaaaagagaatgcgcggtgtaatccacggattttccgccatttcatccagcgcctcaatcagcctgtcaaaaaattcacgtccccgcagatccatgacaagcgcgactttgctcatttttgaacttgattctttcatcagctccaaaaatttcggcagcaaggaaggcggcagattgtcgacgcaaaaatagccgagatcctcaaagctttgaatggcgacggttttccccgctccagacattcccgtaatgatgacgagctgaatatcatggttttcattcatactcatctttctccccccctgcggtctttcttttatttgataagctgcggatctaaacgatagctgagcagctcgaagtccggcgtatacgtaaaggtgccgtgcaaaagcccttggcccttgatcataaaatcaaggatatgcccgtctccgggggccatcggaaggctgtggatatcttttacgtcatgccacttcagaacgccttcctctgattcagcgacattccgccccgtgtaggagtcggcgacgaaagtaaacatcatccactctgacacgatttgttcctgttccttaataataaaggtaaacacgccttttaactgcggatttagtatataaatgcccgtctcttctctgtactctctgatgacggaatctctgacggattcgccgctttccatcttcccgccgggcgcgacccaccagccccgtctcggcttttggagaaggagaacctgatcatctgtctgcagcacacaatttgtcactctttgcacaagtacgtcacctaaccttctcaacaaatcatcgtctcttcattataccgtttcggcatgtctctcacaatgcagagacaccgacatccttttcttttatttgacagaaaacaaaaaatcgcaaaaaaagggcacggatactggaatccgtgccaaagtgtattcattaaaaagggggtcaattactacattcatcttaaaacatcagtatttcacccgtgttacagcgtaattaaaacacagtaacgattcaaaaactgaacattacagtgattatttaacggttttgagcgtttcctcaagctcttccacataatgctgaacgctttgagccgcaatacttccgtcgcctgtcgccgttacgatctggcggagcgttttttcacggatgtctcccgcagcgaaaatgcctgggacttttgtctccatttgggcatttgtttcaatgtagccttcttcatttgtgatgcccaagttttcgaacggtttagaaagcggaagcataccgatataaataaagacgccgtcagctttgaattcttcctcttctcccgtcacggtatccacaagagtaagtctgccgacttttccgttttcctcatggatttcttttacggttttgttccatttgaagtcaattttctcattgtcaaaggcacgcgcctgaagaatgctttgcgcacgcaatttgtcacgtctgtgaacgatggtgacttttgaagcgaagcgtgtcagatagacgccttcttcaacggcggagtctccgccgccgacaacgacaagctctttatttttaaagaacgcgccgtcacaaaccgcgcagtacgatacgccgcggccgcccagttctttttcgccgggaacgccgatctttttgtattccgctccggcagaaatgacgatggcgcgcgctttatattcttttgaaccggctttgaccgttttatattgtttaccgtccacgatttctttaatatcgccgtacgcatattccgcaccgaattttttcgcatgttcaaacattttattagaaagttcagggccgagaatgctttcaaaacccggatagttttcaacatcctccgtattggccatctggccgcccggaattcctctttcgatcattaatgtggataagttcgctcgtgatgtgtaaacagcagcggtcatccccgccggacccgcgccgataatgatcacatcataaattttttcttctgacaccatgattcactccttttcgaaatggggcgcaccctatatgactaagaatccccatcaatcgtattccttacccatatcctattaaatctgagggcaattcgctatttttttgctcatttttctgagaaaccgtgattagggagctcctgagcgggtatacaaataaagaaagagccttccgggatagaaggcccttgtcttattcattattgcacgacacgtcttacattgccgttgaatgctttcttccagtaagggttgctcatagaatcaatggatacaccgtgtgatgtattatcgttcaggaacgttccgttacctaagtagatgccgacgtggccgtttgttttatacgtgttgaagaatactaagtctccgcgtttcatgtcagacgcgcttactgctttacctcttccgattaatgtatctgtgtttgtgccgcttgcaggtccgagattaacgcctgcgttagcataagcccagcgtacgaatgaagagcagtcaaagatacggttgtcaatatcggattgagtgcgtccgccgccgaatttatacggagattgacccacaaggcttgatcctacgctgatcgcgccttcaataccgcctgaatttgaaataacagatccgccgtcagaatcatctgaaccgccgctgttatgagatgatccgcctgaagtgctcttcggtttgcttgagctgtcagatgaatcagatgatgttgaaacagccgcttttttcacagttttaaccgccggtgccggctggctgtcatctttttggttttggtcttcagaagctttttgcgcttcttcctgttttttgatcagggcagccgccgcagcctgctcagctttaatgcgcttctgctctttttcagtgtcagctttttggtttgcaagctgtgatgcttcttttttcagatcagagatagcggaagccgcttttttctgaccgtttttcgcttcgtcgaaaagcttgtctttctgatcaagctgtttgttcaggtctttttgcatagactcgagtttcgcaagatcatcttgaacttttttcagcttcacgttaagttcagcctctgcgtcttcgagtttcgctttatcctgctcctgctgtttgatcaggtctttatccgcatcaacgatagaagatactgcagtcgcacgggaaatgaagtctccgaagcttgtcgcccctaaaagtacatctatgtatccttgagaaccgccgttttcctgtaaagaacgaacgcgttttttcaggatttcattgcgtttttcaatacgcgcttctgtttctttgatttcttttttcaaatcagcgatctgctttttcgttttttcgttttcagcttttttatcttcgattttattgcttgtatccaacgctttagcgttaatgtctttcagttctttttcaatcttagcctgtttgtcctgaagcttggacaattctctttcttttgcttcaaggcttgaagccacctcagattgcttgctttcaattttcgcttttttgctgtctaatgtttccgccgatgcagtttttgtaaacgggatcaaaaaactgcttgtcccgatgacggaagccaaaccaagtgttaataaactctttttcactttttctttcctcccttttactttaaacctgttctcatttggaattctattatgaacatcaaagttacgctccctcacatgcccgtgaggctgatgatttttatgtacgattctttgaatctggttaattggtatagattatacagcacatgtaaaataaactaatctcttatgtacgagactcattataccatcatgtttcgacaatttttattacagttatatttcaatgtgattgcaaatctcatattttgcaaaataaacggtgattacggcctgatttcgattcaaaaagcaaaaaaatacgtatgaatacctcttttttcggcggtaaagttctgttttgcccctttctgataaaaaaagaaccgactctttatatagaaagaatcggttttattctaatatatcatctatttgtctgatgtatttcgaaagggttgccggggttataccgtaaacggcggccgtttcttttttcgtcgttttttcgccgtttgcttctttccatacgtatgcgatggctgcggcccatgcccgctcattctgtacggcagcggcggcgcggatatgctgaatgacgtgaaaaacccagcagctcatgacgtcagtttttaaactgtcggcttccgctttctccagaagcttgaccgtccgatacgtgaacagcgcgtcaccggagacgcctgaagcgcctttttcaccggaaagcagcagtctgacgaaatcttgttcaaacggtgaaacggcgcgttttgccgtcagaactttttcaagctggttccgctctccttcagcgctgctgatataataggcggcaagccgctgttcaagtgaagcaggcagcggttcctgccgctccgcccaaggcgcgggccggtctgattcgggaaattcggcttcggcctttttccaaatggtttccgcaaattctgtgcggcctgtcccgtaggctgaggcggcaagccagtaataaaacgtttcgtcgccttcgaacccgcttttgtaaagagaacggagccatttataaccgagatcatgtctgccgacaagcgcaagcgtcgcccccagcttatagcgctgttcgaataaaatcggatacacgttggcgagttttccgctcaattctccgactttttcattttccctctcgtaatagcagaatacaaggaggttgcacagggcatggagattgccttcatttttctcaagcacttcgaataccgtctgtttcgcttttgtaacattgcctgagtaaaagtaagcgagcgccaggttgttgtatgcagaccaaagctcggggtaatcggccgtaatctcttcaagcatgacaaccgcttcatgaagctggccgctctcaagaagcgtttttgcccggtcctgcctgatcagcagctcatcctggtcatagagtgattcgttttcacccgcttcgccgaaatccaaaagctccatcagattttcaatctcttcgctgaattccccgtccggatcggcatctgaataagccgccgcttctttgtatgcttcctgaaagagccccaaatgcgcgaaattattcgctttaaaataatgacactcgggcatttcttctttcaggttcaccaaaataaagtcgaacagctcatttgactgctggtagtggcccatttcagaataaatgacggccagccgtgacagcatttcggaatcattcggttcgagatggacggcccgctgaatcagtttgctggcccgttttaaattccgctctttatatgcttttaagcctttatgaaaaaaatattgtccatcctgaagcagctggacaatttgcgcgtgctttttctgttcagaagtgtgttttcccacaaatatcctccgttttatacgtattaccgtcagtagtataccataaaacggtttcgcctcaatagttcaaaagacaggatcggcttcgttttttactggctggttcgaccagattttagctgtttttttcacgaggctcggctggaagaatgacgcggaaaagggttccttcgccgcgcttgctctcaacctctatcgaaccgccgtgcagctctgcgattttttgggcgatggacaggccgagcccgcttccccctgcgtttctcgccttatccgctttataaaaccgttcaaatacccgctccgcctgttcaggctgcattccgattccgtcgtcggcgatttcgacagccgccgctcccggcagatcaacaattttaacggaaatgcggccgccttcaccggtaaattttacggcattgtgaatcagattcatccatacttggctgagcagcgcttcatctccgtacacatacgactcctgtaaatcaatgagaaactcaatctgtttggcggaccattcaggctcacaggtcaatatggtgcgccgcagctgtttgtcaatgcggaacggttttttttgtatcggttcggtttggcgttcaagcgcagtgagcttcagcagattttcactgatttttgataatcgttctgtttctgtctcgatgatgtgtaaatagcgcccccgctcctcatatgataaatccggttttttcaggaggtgcgcgtagccctttaatgaagtaagcggggtttggatttcatgggaaacgttcgaaataaattcttgtttcagcttttccatttcactcagttccgcggcgagtgtcgacagttcatcagccaatttcgtcacggggtggtcccgttcaatcttctccattttcctggaggcggccgctgtgaagttgccgctcgacatttgcttgatcgtggcggtcagtgaatcccagatcgcatgatgtctttcacgtgctgactttgaaaagataaacatcgttataaacagcaggccgaaaacaagccagagcgtcagaatctgctcggcgtacggcacaagcaaaatcggccatatgagaccgaatccctgaacgatcagatgagccgccagccataagaatgcggtgacggtgagaaggatgatgatttttccagccgttctgaagatccgtttcattctgtcaccacaaaccgatacccgagcccccgcaccgtatggatagcaaacggatagtccttttccggaaaccgttccctcagccttttaacatgcacatcaaccgtccgctcgtcaccttcataatcaaagccccaaatatcttctattaattgttctcttgaaaacgtcttattcggataaccggcgagcttaaataaaagctcaaattcacgccggggcagcgtcaatcccgctccgccgccgcgcgttacggtgcgggattgcttatctaatgtgacatttccgatggtcagcagtttttcagcggtgatccggtaccgtttcagcaatgctttgacccttgcttccagttcaagcggctcaaacggtttgacgagataatcatccgctccggaagtaaaaccttgcactttgtccagcgtttcgccttttgccgtcagcatcaaaatcggaatgtccgtaaagctgcggacggcttcactgacttcaaacccgtccattttcggcatcatcacatccagtatgatgagatcaataggtgctgattcgatcagccgcaccgccgcttccccgtcttccgcttctgcgacgtcaaagccgctctgctccatcatgagtcggacaagctcacggatatggcggtcgtcatccgcaaccaatatgacagccataaaaatccctccttctgcttttttgcctgtcttcttttaatgaatcgacatgatgtctattaaccatcttattttttcattgtctcctgtatcgacagacactttttttgtatggcggatcatttcctccgtcacttctttcattacgccttgatcagtatcttcacgagactcccagcgcaaaggaacattgtatatctgaatggtgccgtcaccattgctgctgtaagtgactgacccatcgactaaccgggagcctgctaactgcgtaacatcttcgggatagcgggcgctcgtatgatcgtcagggttgacgagtgctccggccggaatgcggcgaacgttcaattcatctatctgctgattttccccaagctgcagccagatgcgggcatattcaatttgcagaggagaataatctgccgacaggcttttgtccgcagagatgtgatgtgaatctttgtttactggttcttttttttctgccgctgatgctgtttcagccttgttgatgccgctgctttctccggccggacttgaagaatggctcggctcttcatcgttaccgtccgtacacccggcagtcatgaatacgagcagtaaggccgcgtgacaataaaaaatctttgtgcgatttttcataatatgaggagaactccggctgcaaaataaaaagcagctttttcagctgctttctattcataaagtcttgctttacacagctttgttttctaagtcggcattcagcttcagctgctgctccgcaaaatcgcggtacagcgaatgggatgccattaattcatggtgtgtgccccgtccggtgatttcaccctgttcgacaaagagaagctgatctgcatccacaaccgtggataaacgatgggcgattacaatcgtggtgcggccttccattagaacttccagcgcctgctggacccatttttcagattggctgtccagacttgatgtcgcttcatcaagcatcagaatgctcgggttgcgaaggagcgctctggcaatggcgatgcgctggcgctgtccgcctgacagcataattccccgctcaccgacctctgtttcaaatttcttcggtaagtcttcaataaattgcagggcgtaggccatgtcagccgcttgcctcagttcctcatcagtcacttcgcgttttaatccgtagcagatattgtcgcggatggtgcctgacattaacgggctttcttgcgacacgtagccgatatgctcccgccatgactcaagggaatacgcatcaatcggttcatttccgagcaggatgctgcccgcagtcgggttgtagaatcgttcaagcagcttaaataacgttgttttcccgccgccgctcggtccgacgatcgcggtgactttgccggcctcaatcgtagccgtaatgtcttttaagatggtttgatctgttttgtagccgaatgagacttgttcgagcttaatcggctgatctgcgttttcaatggcttttccggtttggatatcttcttctttttctgcaagaatatgaatcatccgttccgttgcgccgacggatttttgaagctgtgtgaaaaatgaagtgatctggcccatcggcataatgatctgaaacaaatacaggataaaggcaacgagtgcgccggctgtcaattcaccggatgacacctgcatcccgccgtacccgatgacagcgaccagcgccgccattaatacaagtgtaataagcgggcctacgagcgactgcaccttcgcttcacgcagcccgagtttaaagagcgccatgatgcctgcttttccgcgtccgtattccgcttcttcagcgtttgacgcttttacaagcctgatttccgggaggatgtggtttaataatccggtgaatctcgccgtttcatcctgtgtttcccgagaaattttaaacattttccggccgatcggcactaaaatcatcgcagccagcggaacgacgatcagcacgagcaatgtgagcttccagttcatgaaaaataagatcgtcagtgacccgataacggaaatgattccggtaataaatccgctgatattgtttgtgatcagctcttttaccaccattgtgtcattggtgacacggctgattgtttctcccgtggcgtttttgtcaaaataagagacgggcagtttaattaatttctgccacaacaaatcacgcagtcccgagatgattttctggccgctgtagttcagggcgtaggtggcgtaggcgcttaatgcggcctgtacgataaacacggctgcgatgattccgatttgcacgcctgacagcgacgacacggaaaagccgtcaacgagctgctttgtcaacagcggaatcagcaggctgacgagcgttgtcacaatactgagagacagcgcgaaggccagcataccgtatgatggttttgtttttttgactaatgaaaagaatgagttgaatttcccttttggttttggttgtttattcggcatatgttttcctcctatatcactgtttatactataacggatgtgcatgaacggaatatgaacaaaacgtatatttttgataaaaaccaaaataaactctattagtcaatattatcaaattcatctgccttcggttgcggaaataagaaatattttattgaatgtttaagtttgacagaataaaaacctcacggatctctccgtgaggtttgtttttactcagatgctgaatggcgtttcgcaaggacgtcaagcacgtcatccaaaggaagcgactgctcacgcagaagaacgagcaaatgatacagcaaatccgccgcttcccattttaattcttcatggtcgcggttttttgcggcgataataacctctgcggcttcctcgccgacttttttgaggattttatcgacgccttcccgaaacaggtacgttgtgtaggctccgtcaggcatctccgcctgccgtttggcgatcacgctttccagttcatttaagatgccgaaacgatcctgcgcgtctgctttttccgtggaaaaacagctgtagcttcccttatggcatgcgggtcctgagggctccgcaagcacgacgagggcatcttgatcgcaatcataacggatggctttcaccttttgggtattccccgatgtcgctcctttatgccacagctccccgcgtgaacggctgtaaaaccaggtttctttcgtttctatcgttttttcataggattctcggttcatataagccagtgtcagcacttctttgcttgccgcatcctgtatgatggcgggtatcagtccggcctcgtcaaaccgcagttcatctgcctgtttcatctcacattcaccccgtgtttcttcatataatctttcacttcttttatagatgtctctttgtaatggaaaatagaagctgcaagcgcggcgtccgcttcaccgactgtgaaggcttcaagcatatggcgcgcgctgccggctccccctgacgcaatgacgggcaccgggacggcacgtgagacaagctgtgtgagcgtatgattaaagcctgttttttcaccgtctgcgtccatgcttgtcagcaggatttcacccgctccccggctgacggcttcttttgcccaggccgtgacttcccgctcggttttctgtctgccgccgtgcgtgtacactttatagcaatccgaatcttcgtcatactttgcatcaatcgccgctacgatgcattgcgagccgaaaaactcagctccttccgtaatcagctcgggacggagaacggccgctgtattaacggataccttgtcagcgccggcgcgcagcattcgtttcatatcgcttaattgattgattccgccgccgaccgtaaacggaatcgccagttttgccgcaacttgttctacgacgtctgtcatcgtcttgcggccttcgtgagaggcggaaatgtcgagaaaaacaagttcgtctgcgccctccctgtcgtaggcttcggccagctcgacaggatcgcccgcatctttcagcccgagaaattgaatgcccttgacgacgcgtccttctttcacatcgagacacggaatgattcgtttcgtgatcatgcgtccttcacccttctgagcgcttcagccaatgaaaattgttttgtatacagcgcttttccgataatcgctcccgatacgccggcgtctttgaagcgggccagtgctttgaggtcggcgactgagctgactccgcctgaagcgatgacgtcttttcccgttgcttttgcgagctgaacggtactttcgatgttcggtcctgacagcatgccgtcagttgcaatatccgtgaaaatgaaggtttccgctccttcggccgccaattcacggcccagatcggccgcccttaccgaggatgtttccagccagccttccgtcgagacatatccgtttcttgcatcaaggccgatcgcgattttgccgccgtattgtttcagcatgctcttcacaaatgccggatcggaaacggccgagctgccgagaatgacgcgatcaacgccttgtgataaataaccgtacacatccgcttcagaacggataccgccgccgatctcgactttgacatcaagctgccgcgcaatgtcaagaacatgcctgtcgtttactttcctgcctgctttcgcgccgtcaaggtccacgagatgaatccattcggcgccttcttgtgcaaattgcgccgccatgtctaaaggagagtcaccgtatatcgtttccttgccgtaatcgccttggatgaggcggacgcatttgccgtttctcatatcgattgccggatataatgtaaaagcgttcatttcttcaccttctgttccgctgccatttttgtaaattgtgttaagatcgccattccggctgtaccgcttttttccggatgaaactgtgcaccgaaaacattgcatttcccgacgacagccggaacacgaacgccgtactcagcgcttgccagaagatcgccgtcttccatcccgtctatataataggaatggacaaagtaaacgaagccttcttccgcttccgaaagcaaaggagacgtttggtgaaacgtcagccggttccagcccatatgcggcaccttcagcttgtttccttcggcatctctgtctttgagtctcacagcttttccggctaataaaccaagtccttttgcagagccgttttcggcgctctcttcgaaaatgagctgcatgccgaggcagatgccgaggagcagcttaccctcgtcaaccatacggtgtatgaattgatcaagcttcgtgctgcgtaaattgaccatggcgtcactgaatgatccgacacctggaagaataaaagcatccgctttttcaagctcttccggccggtctgatacgacatacgggacgccgacgcgttccagcgctttcgacacgctgaataaattgcccataccgtaatcaattacaccgatcatttacagcattcctttcgtagacggcacacccttgacgcgcggatcaatggatgacgcttcatcaagcgctctgccaagcgccttaaatacggcttctatcatatgatgggtattcgtgccgtaatgaacgatgacgtgcagattcattctcgcttcgagcgccagtttccataggaattcatgtaccagctcggtatcaaacgttccgactttcgcttgcggaaatgcagcgcgcatctcaaggtgcggccggttgctcaggtctacggcgacttgggcgagcgcttcgtccatgggcacaagcgctgatccgtaccgtttgatcccttttttatcaccgagcgcctccaaaaaagcctgccctaaacagatgccgatatcttcagtcgtatggtgatcatctatctccgtatcgccttttgcgtcaaccgttaaattgaattgcccgtgctttgtgaacaaatcaagcatatgagtcataaacggcacatccgtgctgatgtcggcttttccttctccgtctatttcgaaagccagccttatatccgtctcatttgttgttctggcgcgttccgcttttctcatcggtcattcctccgtttctcgcttcaatcgatcttgcgtgcgcttccagcccttccagtctcgcgaaggcggaaatgctgtccgcgtgcgtttcaaatgccttccggctgtaagagatgatgctcgatttcttttgaaaatctgttacattcagcgggcttgaaaaccgcgccgttccgtttgtcggcaaaacgtgattcggtccggcaaaataatcgccgaccggttcagcgctgtatcgtcctaggaaaatcgcccccgcgtgtctgatgcttccaagcaaagcctccggcgaatgcgtcatgatttctaaatgctcgggcgccagctcattcaccgtgtccaccgcatcttccatcgattccgtaatataaatgcggccgtgatccctgatcgacgcttcggctatttctttgcgcggcagggtctgaagctgtttattcacctcatctgataccgcttcggcaagcttctgtgaatcggtgacaagcacgcttgaactgagcatatcgtgttcggcctgtgaaagcaggtcagcggcgacttcttcgggcaccgccgtatcgtctgccaggaccacgatttcacttggcccggcaatcatgtcgatatccacaacgccgaagacttcgcgcttcgcgagtgctacaaatatatttccggggcccgtgatcttatcaacaggctgtatcgtttccgttccgtaagcgagcgcggcaatcgcctgcgcgcctcccgctttgtaaatttcctttatgccgagctcagacgccgccgccagaacgcccggtgaaaggcgcccgtcttttcccggaggactgacgagaacgatccgttccactcccgcagcgagagcggggatgacattcattaaaacggaagacggataagcggccgtcccgcccggcacgtatacgcccgcggaatcgagcgccgttattttctgtccgagcatcgagccgtctttgcgatggtaaaaccaagaggattgcagctggcgctcgtgatattctttaatattggcaatcgcctgtctgatcacttcaagcagctgatcatcaagcagacggtatgcctcggtgatttcctctgcgctcacggccatttggttcaggctgatgccgtcaaatgtttttgtataggccaaaacggctttgtcaccgttttgtctgacgtcttcaataatccccctgacggttttccgctgctcttcggttccgctgtcgatggaacgcttcagtgaaaaccgctcgcttctttttactgcggttatgttcattttgccgtttctccttccacaacccgtgccagcctggccgccatttcgtcgattacatcatccttcatgcggtagctgaccggattgacgataaaacgcgatgtgatgtcacaaatatgttctgattcaacgagaccgttttcctttaatgtccgcccggttgatacgatatctacgattctgtcagcaagcccgattaaaggcgccagctcaatggagccgttcagcttaatgatttccacctgctcgccctgctctctgaaataactcgacgcaacattcggatatttcgtcgcaatcctcggtgcgactccgttccaatccgccccgggaagccccgcaacggcgagatggcatttgctgattttcagatcgagcacctcatacacgtcacgctcttcctcaagcatgacatcctttccggcaataccggcatcagcgacgccatgctcgacataagtcgtaacatccatcggctttgccagaataaagcggagattttcttctggaacgtcaatgatcagttttctcgattcttcaaactcctcgggcagcctgtatccggcctgcctcagcaacccggccgcttcttcgaatatccgtccttttggcattgccattgtgagtaccttacccattcctctcttcctttctggcaccgataaagtatgtgacgtttgcgaatgattttgtcatatgatcgatattttcaatgcccgccagatcctgcaggacgacttttctgcctctcgccctttcttcctccgcgaataaaatagcctgggcccgctgctccttgctgaaaatcacggcgtccgcttcacttgtttcttcctgaatgccgagcgcttcaatcagcctgtcgatacggagcccgaagcccgtggcgggagcgggactgccgaaatggccgaggagattgttatagcgtccgccgcttccgatgacgaaaccgacatttgccgcgtacacttcgaataaaattcccgtgtaataactcatatggcttaccatattcagatcaaggcgaatatgctcggcacatccgtaatcctcaagaatgtcccacaggtcttccagctcctgaattaagctttgtccggagattccgatgatctcctccgctttggcgcaaatctctttcccgcctcgcaattccaaaagtgcgagcagccggcttttgtctattgaagaaagcggaagcgatttgacatgttccctgtatcccacgtaattcttttcaaagagaaagcgccgcagaacatccgcccgctcggcattacccaaaacctcgacaaacagctcatcagcgagtccggcatggccgatcgcgattttaaaccgttgcaatcccgcgtttttcaaagcgccggcagccagcgcaatcacctcggcgtccgcgcttgttgatccgtcgccgatcagctccgcgccgacctgttcgaattcggccggacgtccgccttcccgctcctgagcgcgatagacgcttgccgcgtaccccgctctgagcggatgattgtgtttgtgcagcttagatgccgccaccctggcaatcggtccggtcatgtcaggccgaagcacaagcgtttttccgtcctgatcgagaagcttaaacagctgctgttcttcaatggctgactggacgcctactgtttcatagaattcaagggtcggcgtctccataaactgataaccccatttatcaattaaatccgtcagtgcggaacggacttttttctttgcttcgtataaaccgggcagcgtatctctcatgccatgcggtttctcaaacataaacatttaccttttacacctccgctttgtctgaaggaaaattccgaatcctttagttcgctaatatgataatatgttagcagataaaagaatggattgcaacgcccaatgtccgcctattcttttccataaacatggctaaagaatgaacaaacctgtaaacatatcggaacgatcgaatcatattgagcagaagtgctataatacatagaacagcttcatcagaaacaagggagaataattgataatgaagacgcttggaacattatgtgtgctgattctgacagccatccttgtctatctgggatataacatctatacaaacgatattcatttaaattttttcaatcagcagtccgacgagcctgatgagaaaacaccgttaaaagggagcgcgtcaccgctgaatgtcgttctgtacagacagatggattctcccagactgtacaatggctgtgaggtgaccagccttgccatgattttgaacaatgccggatatcatgtgtcaaaaaatacattggcggataaaatcaataaagttccgctcacatacagcagcgggctgaagggagatccgaatgaaggatttgccggagatatggaaaacggcccgggtttaggcgtttatcatgagccgattgataaacttgccaaagaatatgcgggaaacaaagtatacgatcttacgggaaaagacatttcttcagtgtaccgccagcttgaaaaagggcggccggtctgggtgattaccaccacatcctttaagccggttgatcatatgcagacttgggatacaccgaacggaaagatcgacattacgttcagcatgcatagcgtagccgtaaccggttatgatcacgattatgtatacgttaatgatccttacggctataaaaacagaaaaacagaccggtctgactttgaaaaagcctggaagcagatgggcagccaggccattgtgatcaagtcataaaaaaaccccgctgacgttaatctgcggggttttccattcgttttttcatttcttcgcgcgtatagatcagcttcatcgggtttcctccgacaaacgccccggccgggacatctttgtgcaccagcgtgccggctgatacaacggctccgctcccgatggtgacgccgggcagaatggttgtgtttgccccgatcatcacctcgtcaccgattgtgacaaaaccggtccggtactcatgtattaaatattcatgagccaaaatcgtcgtattgtagccgataatgctgttttttccgacagtgattttttcgggaaacatgatatccggcatcaccatcagcgcgaatgacgtctgttttccgacattcattttcaaaaaggttcggtacagccagtttttcacgcttaaaaacggcgtataccttgcaatctgaatgatgatgaaatttttcatcaccttcaggaagggaaccgtctgataaacatgccacaatgaatttgcacctgcaaccggatggcggtctgtttttctcacgggttacttcactccggtgatgtgcaataaatcactcattttctcgagcatataatcgggttcataggcggaaagcgtctgtgcgcctttaatcgtccacgcgacgccggctgttttcgtgccggcgttttttcccgccatgacatcgtgataattgtcaccgaccatgatggcttccgacggatcgcacccaagccgtctgagagcaagccgcacaggctctgggtcaggcttcggctgcttaacatcatcaagcgtgacgacagtatcgaaaaacgccccgatgcctgtcagcttcaatcccatattgactgtatccctcagctttgtggtgacaataccaagctgatagcccgcttttttcaattcatccagcgtttcataaaccgtttcgtactccttgacgagctcatcgtgcttttcatggttgaatgctctgtacatgctgatcatgtcatcgcacttttcggcattaatgcctgaaaacgtttcgtacagaggcgggccgataaacggaagcacatcttcccttttaaactgccccgggcaataatgatcaagcgtatgaaggtaagaagcgataatcagttcattcgtgtcaatcagcgtgccgtcgagatcgaataaaatggcggttacatgtttatcagtcatcttatgtcctttccgatttcagtcgtcagtccgtgtcagcataccgcttatcggcataccccttcatgcgtctgaaaatcattaaaataatcgcaagtataatcagcacaatggagatgacctgcgcgatccgaagctggctcgtaagcatcaggctgtccgtccgcattccctcaataaagtatctgccgattgaataccagatcacatacgtcaaaaacagattgcccctgcgcaggttcacgcggcggagcagaagcagaatcacgacgcccgcaaaactccacagcgattcatacaaaaacgtcgggtgataatattgtccgtctatgtacatctgattaatgatgaaatccggaagatgcagactttccaaaaatgaccggctgaccgctccaccgtgagcctcctggttgataaagttcccccagcgtccgatggcctggccgagcagaatactcggcgcggcaatatccgccagcttccagaatgagatgcctcttacttttgaaaagacaattcccgttgcgatcgcgccgattaatccgccgtgaatcgcaatgccgcctttccaagttttaatgatttccccggggtgttccgagtaatagctccactcgaaaagcacataatatgcccttgcgcaaatgattgcgatcgggatggcgaaaagaacaagatcaataaaaatgtcctttttcagcccccgcttttcactctccctcatggccatccaaagccctaataacgcgcccgcgccgataatgatgccgtaccagtgcacggataaaggcccgagctgcaaggcaatcggattgatcggtgttccagcttcattcatattattgccaactcctattcgtcttgttcgccgtcctcaatgacatccgccagcttattcgtgaattgttcggcagcatttaagcccatccgcttcaatctgaagttcatcgccgcaacttcgataataacggcgagattccgccccgggcggacgggaatggtcagttttgtaatttccgtatcaatgattttcattttttcttcttcaagtccgagacggtcgtattgctttccttgctcccaaagctcaaggtccatgacgattgtaattcttttattgcttctgacggcgcccgccccgaacagcgtcatgacatttataatgccgagccccctgatttcgagcagatgctcaatcagatcaggcgcgttcccgacaagggtatcctgatcctcctgccggatttcaacgcagtcatccgcgacaagacgatggcctcgtttgacaagctccagcgccgtttcacttttaccgacgccgctttttcccgtaatgagcacgccgacgccgtatatatccacaagcacgccgtgaatggccgttgtcggcgcgagacggctttcaagaaaattcgtcagcctgcttgacagcctggttgttttcagaggggatctgagcacaggcacgccgttttgctcggaagcttctacaagctccggcgggatcggcatatctctggaaagtatgatagccggcgtcacatcggtgcacagcgatttcatccgctgtttcttatcttcctcgggaagctgatcgaaaaatgacagctccgtttttcctaaaagctgcacccgttctctcgggtaatatgtaaaataaccggcgatttcaataccgggccgtgataaatcactcatcgtaatcgggcggttaatcccttcttctccgctgatcaattctaaatggaactgttccattacgtctttggtccgaacctttgccaagatatgttcctcctgttctgggatgttccgagctttgaacagttatattttatcactttaccgtctgaaccaaaacagatttatacaattccggcataactggtctagataactagtctgaaaaggagtaaaataaaactaacaactaaccagaaaggcgtgttttaaagtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggttcgtatgcgcttcccggaatgattgatatccatattcacggcggatacggtgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacaaacgcaggagccgagcttttacaaaaagcggcggatgccggggcggtgcatatgacgcacctctttaacgccatgagctcctttcatcaccgtgagccggggggcatcggtacggctctcgcctgcggccgcatcacggcggagctgatcactgacggcattcattctcatcctctggctgttaagcttgcctatttggcgaaaggaagccaaaacctgatcatgattacagactccatgcgggcaaaagggcttaaggacggagaatacgaattcggcggacaaaaagtcaccgttcgcggggacacggcgcttctctctgacgggacgctggccggttccattttaaaaatgaatgaaggcgcggcgctcatgcgcaggtttacaaactgctcatggccggatatagcaaatatgacatcggcaaatgcggcccgccgcctcggcatattcgaccgtaaaggaagcatcgccgaaggaaaagacgccgacgttgttctgacggacggacagtgcggcgtgctggccacgatttgccgcggaaacaccgcatatatctcaagggaggctgattggacatgaacgttatcacatgcagacattatgaagaattaagtgaaaaagccgcagcgattatcgctgaaacagtgaaacaaaagccggatgccgttctcggccttgcgacgggaggcactcctgaaggcgtatacaaagaacttgtgcggatgcaccgctcagaaggcttgtcattccggaatgtcacgacgatcaaccttgatgaatacgccgggctttctcccgaggacaaaaacagctatcattattatatgaatacacatttttttgcacatatcgacagccgaaaggaccgccactttctccctgacggacgggcagacgatcttgatgccgaatgcgggcgctatgaccgattgattcaaacactcggcggagcggatatacagcttttaggcatcggacacaacggccatatcggctttaatgaacccgggacgccatttgaatcccgaacccatgttgttgagctgaatgaagagacaagacaggcgaatgcgcggtactttccgtcaattgatcaagtccctgaaaaagccctgacaatggggatcgggacgattttgtccggcaaacggattctgatcatggcatccggaaaaagcaaggcccaagcggtgaagcagcttctggacgggcgcgtcagcgaagcattccccgcctccgccctgcacgcgcatccggatgtgacaatcttgattgatgaaaaggctgcgggcggcgattgaaaggatttgacctatgcagattgataaacaatctccgattccgatttactttcagattatggaacaattaaaaacacaaatcaaaaacggcgagctgaaagcggatgcgctgcttccgtcggagcgggaatacgccgaacaattcggcatcagccgaatgacggtgcgccaggcgctttccaatttggtgaatgaaggatttttatacagacagaaaggccggggaacgttcgtcagcaaactgaagatggaacagccgcttcaagggctgacaagcttcaccgaagatatgagaagccggggcatgaagccggggagcagacttgccgaataccagctgattcaggcgacggaagaattatcttctatcctggggtgcggctatccggcaacgcttcataaaatcatccgcgtccggctggcaaatgatatcccgatggcgattgaggcatcgtatatcccgtttgacaaggcgggaaaattggatgcctcccattttcaatcatccatgtatgagcatattgaagcgtacaatcagatgccgatctcacgggcaaaacaagagcttgaaccgggaaccgcttccgaggaagaagctgagctgctcggtatccagcccggcgcccccgtcctctatatcaagcggaccacttatctgcaggacggcactgcctttgagcacgtcaaatccgcctacagaggcgaccgctacacattcgtgcattatatggacagggtgaaatgaaacatctccaaccgttacgggttggagatgtttttttgatctgccattttcaaatcaagccggtgaatgttctctatgactctgtcaaaacgaagaggctggggttccggtatctatttttataaagaaaagagtaataaaatgctatcctctgttttggacaatatacggaacctgctttgaaatcagcagcagcggttctttgtttttatgagccaatgaaaacatgattgcgccttcaatcatcgagttgattgtcatcccaagcttctccgcttcctcttgttcaaacccatgctcaagaaattttgccgcaaacacatccgtccacttcttgaacacctcaacacatgtgcatcttaacgtttcattgatcagagcggtctcacccgccagcaatccaaccggcacgccctcaatattctgcggatcattaaactgttcagccgttacatgaataaagtgctgaatcgcttctacagggtccgcggattgagacatactattctgtatctgcttttcaacgcatcttcccgtatatttgatcgccgcaatggcgagttcttcttttccgtttggaaagtgatgatacacagaccctctgggtgctccgctctcttttataatttgattcaaaccagtcgcatggtatccctgaatctgaaaaagatatgcagaggtttgaataattctttcttttgtcccggttttactgttcattatgtttcctcctgcatattacgaaaaccaatcgattttagtatagaaaagggacataaaaaagtcaaaaacacttagtaccgccatgcatgttacagaaaaaaacctgctgaccgtcagattttcttctgaccgatcggcaggctgtatgtttttgctatgggtttgaggcatgcctgaaatcaaactgatccggagccgggtgatacggcgtatttcccgttttgaacatccacagcggtgatattgttttgccgttgtacgggtccttcacgacggtgtaccagtaataaacggaatcaggctgcaggccgtcccagacccaatttgcggtttttccgctttttacgtgttttttatgaccgagcagttcgttcgtataaacgttgcattcaaaataatcagtcgctacccgtttcctcttcggctgtaaatccatttctgctgagaattcgtctttatcagcgaacagatcggtgtcatagtaattgatgtcatccgtgtacggcgagtaggagaacatgtgaacctgattggcggcctgatcaaattgcattatgcgcataaagccctgtcccccttccggaccgtcctggtagtcggtcagaatttggtggacgaggcggtccggttttccgtctccgtcatcgtcaagcgcatcggtttttttcatggcgttatggtaatggccgcttaataccatcgccacattgcgattcggcttgacgatttttcgatagatcgtctccccgatcgggcttcgatttccgctcacaagcaagtactcatgaaagcataagatggcggttcggtccggatacctcttcagcacttgattgatccagtcaatctcttgttccgtaatgccccagcccatataaatcataataaaatcgttcccgcttgccgacagcagatcataatgcccgcggttatttttgtatgatccgccgtaatgcatgttctgttcaaaccggcggctcccgaagaaatccccgaaggttcggtatgtgccgtctttatggccgacgtcgtgattgccggcaagcactccgtacggaatccccgccttgtcaagcgtccgcatggagtgatcggcgtttttccactgtttcatcaccattgaatcatcgacaatatcaccggtatgaaagacatatttaatattgtgcttttccttattttctttgatccactccgtcattttgtcaaaaatgtgcgggtgcccttgtgcgtaatactgtgtatccgacatccagacaaacgtgtaattgcctttcgccggtatttgatcctgcacgatgacattcatttttgagttcttcaccacatccgctgcggaaacggcggcttttaatgtaaacggctttttatctttggcaaggacgctgtccgcctcctgccagcggcttgtccggtaattccagatatacatggttacctttcggccgggcagagagcttcctttccagaccgcctcggccagatccgtttcgtcgatagacgggtcaacggagacttcgaaccggtgataaggaaaacgctccatactttccgccgaaacggtttttccgtcatttgccgagatacggttcatttccggcagggtaaacggcatttcattttcttttatgcccttcggcggttccgttaatgaggcgtgtttatacactttcacgctgcccggattccgcgcggtataacggaagccgcgataaaatgatacattcatgtcatccttcgtcgggtcttttacccggacggacagctttgctttgcgggcgccgattttttgaccggcaagctccggctggttcggctcctcccgtttgatatggaaggtgcggacggacgttgtttcatttccggcaaggtctgccgcaatgatagtaagggtgtgctttccgggcttgagatcggctgatgacgtgtgatgcgggagcgtaatgctttctccgtccaaaaacgctttcacctcttccactttgctccatttatcacggatgtccgcattcagctcaacattacctttcagcgccgctccttctttaatacccgggacaatcttcggccccgaattgtccaccctcacagattggctcagctgctcctcaccgtcactgacaaaaatatggtgatagccttccgaaagcttcgccgtgttccacagcagcagccgtgacgtaaacaaatgatccggcaggctgaatgagaaggtcttctgctgattcgcccgcttgccgtcaccgataaacagctgctcggacgggtccgtcttcccgtctttgatcaccgttccgtccgaaagcaccagacgggcatgtttcacgacaaaatcatcccgattctctcccgtgtcatacggagaaacctttgagcccgaacggatggatactttctgtgttttgcccccttttagcagcagacgttccggaagcagaaccgagtgcgttctgtagcggtgagacggatcgtcaaaaatgtgcagcacctcgttttccatcatgacggtgttttgaaaataaagattcgttttccgggcatcgaaggcgaaatagacctctttttccagcgccggccgggtctcctgccgcttgccgtcaatccacagcttgatctcatcggcgctgacgtcggaagtcgctttgagcagataggtgccggatatcgtatcttccggttcaacattcattctgagtccgtgtgatttgctcgtctgttcaatgtcaatcatcttgacgggcgtttttgcttcattttctccatcactggctgcgatataatactcaagctgatcctggccgagcagttccggggaataaagaatgtgatggtataagctgtcgttgcggtctttttcggccagaattcgtttgaatggttttttctcattggtccggtaataaaacgcggctgttttgacaaggtttttgtcttttatgtcagcctttaattcaatgctttcagcgggccggacgggctttctgtctgtaaggtcttcgatgaccggtttttccttgtccggtttgatcacccttttctgctgcggaatctgcgcctgaaaaacggagcccggtgacggcttatgctcgctcgtggagatcttcagcaattctcccgttccgttcagcggatatttgtacagcaaagaagtcagccggcggaaagcgtgtttccggtattgcgctgaggcgatatccttgccggtatttgccgacagcacgaccgtacgcgggcggccgttggacattccgtctgtcccttcgatgacggcgagatgttctccttccttcagacgtgtcccgtaatagcggttgaaatcatctatcgtcagttctgatgcggcgcgtctcagccaaaacacgtaagtcccgcctgacggaatgacggtatcttctttcggcctccatatcatatctgattccggcccttccttcggatagcggtagcggatatgatagtctttaaaatgaatgggcctgtccgtcgtgttatacacctcgataaattcataggcatcagcgccgtcttcatttttcgtatcaaccgcaagctccgtaatcatcagctcgggaatatgattcaaatcggcttgatagccgtccagcttcagccgctttttctccgattccgcccgctgtctgccgttggtgaaaacgaggtaatattccaattctccattccagatatcccgttttgaaacctgggccgtaaaaagccggattgcgcctggcgcgggctccatcggcaccatcttaaaccccagctcattgctttgtttataaaaaagaaacgccgaaaacgcttgatagtcagcattccgtacatgagcctgtatgaacaggtttcttttcatttccgcctttacttcgatttggggaggattctccagaagcggtatgtaatgaggcggctgtccgaattcctgctgattcacggggatcgccgattctttgcgcgccgcatccgcagaaggactcacacaaagcaaaccaatcagaaaaaagagcgtcatcacaagtttcatctcattacctccctatgcattatgttgcgtcaggaggctgccgcttatgtaaaccgcacataaaaaagctgccctctcgggacagcttgttttttatccttttctaagcggctccaatatgcctttttggatcagcaagtggaaaacggacagcacgacggatgcccaaatggcggtgccgaacccgtcaatctgaaagctgtctcccatcaaggctgcggtcatcattaacgtaatagcgttgatgacaaacagaaagaggccgagggtcacaaccgtgacaggcaatgtcaatatgacgatgatcggtttgatcagcacatttaacacagaaagaatcacactggcgatgacagccgctccgatactgctgatatggacggaatcaaaatatcccgcgataacgattaataataaagcatttactaaaatgctgactgcccatttgatcatttatttcaaatctccttctaaaggtacaacaaaacaccagataatatatacaatcggcacgattccgctcgtgacaagcgctaatacaacggttataatgcgcaaaagcgacgcatccatattgatgtactccgccaaaccgccgacgacgccggcgattttacggtttttttctgaacggtaaagtcttttcatccaatcacctctgagtatgcttgagcttaatggctcctgttaacgattctgagaaaatcgagagatgctgatcatggccttgatttgatgccagcatcagttctttttgaatggtatcattcttttcctttaaaatttccgcatcaatcagctcatggctgagagagccgagattgcttttgagctccgctttcaccgccgaatcatcaggcagagcgatctccacgtttccggtcgtcgttttcgtgtagatggagcggcagtgcggcgctgtcacggtaagcatgatattgccgttaaagctttgaacgtcaatggattcactcgatccgcgcaaatcaatcaagccgttgatcgtttccgcttcaatcgcgccgcattgatgtccggccagcttgatttgtccgttagccgtttccgccgacgctttctcagccgtcaaatgagagaatgacagaacgccgtttgttgttttcgccgagaattcttttacatgtaaatgttcccctctgatcggtccgttaaacagcttcactcttatcttatcgtactctttctggggaacataaagcgtaacattggttttcatcgttttcttttccgtgcggacaaaaaacttattgcccttcacttcacactcaatatgctgaagaaatgcggtgcgcgccgcctcctgactgtccgcccggtacactttcgcctggcactccgctctgatatcttcatccgcccacggcacgatattgacgctgccgtttgcgatctgcatatcaatggccgagaattcactgtctttaaattgaaaaatatgctgcacttcgtgtgcgtggccgaaattcagatcaagatccgcttccttcacttttttgacggcagaatcaatccagtcgaacagcttcgccccgagcgacggcttttggcttccttttgcaccgctttcgaaatcttccgcaggttcctgaacctccgcagataacgcggtgatctgatcttctttttctttatattcatgatccagtttttcaatgagcgtcagtgcttcctgcgccgtcagcatgccgtcttccacaagctttaaaatccgttctttctcctgtttcatacaaaactcctcccccgacttttcttacacctggcgtaacaccttaattccctgcacgatattccaaatgaccattccgatgaggatcagaaaataaacagctgctcctgttatcataacaaaaacgggcaccatactctccccctgggccgtaatcaatccgccgacaacaccggcggtcacaatcagcaagcccgcaaacggaatgatatgggaaatcagagcacgcatggcatgccgcttcgtctctttttcatcgacgacaaagtaagccacaatcggaagaatgagcggcgcgagaaacacgctgaaataacagattgatgcgataatcgcttgatttcggttcaataaaaacactccctgtgccgtgatataaaaaaccattccttatacatacgtatgacgaatgagcgggtttcattttcatgctaaggacatgcttcgttatacgtaatttttggtttcagagatttcactatagaatcttttccccgaaccgattacaatatgtaacaaagcctgaccgtatgcaaggaggacatacaaatggagaaagatcccgaaaacgcccaagtaacggaagagagtcttcgaaatttaattcgcgaacagaaaagaatgaacagcgaaatgctggctgaattggaacagatcaaagcagcccctcttcccatttcccatgatatccaatatataaaagtgctgctggacagcagcagcacccatattctgcaggacttaatgcatttaagcagacagcttccccaacagaaaaaaagcctgtaacaacaacagcccaaaaccgatgagttttgggctgtttttattgatctattacgtggctgccgtttctttttcggccagcaatgttttcatccgttttttatcgcgttccattaccggtttcagatagcggcccgtatatgattctttcacttcgacaacttcttcaggcgttccggaggctacgatcgtgccgccgcccgctccgccttcaggtcccagatcgacgatgtagtccgccgttttaatgatatcgagattgtgttcaatgaccaaaacggtatcaccgttatcgacgagtctttgaagcacaaccaaaagccttgcgatatcatcaacgtggaggcctgtcgtcggttcgtccagaatatacagcgtccggccggtggaacgcttatgcagctcggaagcgagcttgacgcgctgcgcttctccgcctgacagcgtcgtcgccggctggccgagcgtcacatacccaagtccgacatcagcaagcgtttgaagcttgcgtttgattttcgggatattttcaaagaaagacagagcatcttccaccgtcatatccagaacgtcggaaatgctttttcctttgtatgtgacctcaagcgtctcccggttgtaacgtttgccgtggcacacttcacacggaacgtacacgtcaggaaggaagtgcatctcaattttgatgatgccgtcgccgcggcaggcctcacagcgcccgccttttacattaaaactgaaccggccttttttatagccgcgcacctttgcttcatttgtctgcgcgaatacatcgcggatatcatcaaacacacccgtgtaagttgccggatttgatctcggtgtccggccgatcggcgcctggtcgatgtcgatcaccttatcaaggtggtcaaggcctttgatctctttatggcttcccggtttcgctttggctttatgaagcttttgcgcaagcgccttatgcagaatttcattcacaagcgtgctttttcccgaaccggacacacctgtcaccgccgtaaaagtgccgagcgggaatttggcgttcgcttttttcaggttgttttctgaagcgcctttgatttcaatgaaccggccgtcaggctttcttctctccggaggcatcgggatgaattgagcccctgacaaataacgtccggtcagagaatccgcatcattcatcacttcttcaggcgtccccgccgatatgacgcggccgccgtgaatgccggcgcccgggccgatatctatcaagtaatcggcagccatcatcgtatcttcatcatgctccacgacaatcagtgtattgccgagatccctcatgtttttcagcgcgctgatcagacggtcattgtcacgctggtgaaggccgatggacggctcatcaagaatgtacaggacgcctgacaaacgggagccgatctgcgtcgcaagcctgatacgctgggcttctccgcctgacagcgttcccgccgccctgctcagcgtcaggtaatcaagaccgactttatctaaaaagctgagacgctccacaatctctcttaaaattaaatcggcaatctgcatatctttctcagacagcgtcaggtttttgaaaaattccagcgcatcgccgacggaaagctcggtaatggtgccgatgtggcgcccgttgaccaaaacggcaagcgcttctttcttcagccggtagcctttgcacgtcgggcacggcttctgtgacatgtactgctccatctgttcacggatataatcggagcttgtctctttataccgtctctcaatattgcgcagcacaccttcaaattcaatttcattttcgcgcacttgtccgaaatcattctcgtatttaaagtagatccgttcattgccgctgccgtacagcactttatcaagctgatgcttcggcaggtctttgaccggagtctccatatcaatgccgtaatggcggcagaccgcctgaagcagctgcggataatattgtgaactgatcggcgtccacggcgcgatggcgtgttcctttaatgacagttcaggattgggaatgacaagctcagggtccacttccagcttcaaaccgagaccgtcacaagtcgggcaggcgccgaacgggctgttaaacgaaaacagccggggttcaagctccccgatagaaaaaccgcacagcggacaggcgtgatgctcgctgaacatcagctcttcctgaccgatgacatctatcatgacacggccttcccctaagcggagcgcggtttccagtgaatcggaaagccgggcggcaaccccttccttgacgacaatccggtcaatgaccacttcaatggaatgctttttgtttttttcaagttcaatatcgtcggaaagctcggccatttctccgtcaatccgcacccttacgtaaccttgctttctgatttggtcaagcactttgacatgggcgccttttctgcctgagatgatcggcgcaagcacttgaagcttcgtccgctccggatattcaagaatccggtcaaccatctgttcgatcgtttgcgacgtaatttcaatgccgtgctccgggcagtgcggcttcccgactctcgcgtataagagccggagataatcataaatctccgttactgttccgacggttgaccgcggattgcggctcgtcgttttctgatcaatgctgatcgccggagaaagcccttcgatcgcatcaacgtccggcttatccatctgccctaaaaattggcgcgcataggcagaaagcgattcaacataccgcctctgtccttccgcgtaaatggtgtcaaaggcaagggatgattttcccgatccggacagccccgtcacgacgacgagctgatcccggggaatcgttacatcaatgttttttaaattgtgcgcccttgcgcctttcacctcgatccggtcaattgccatgtgttcatcatccttccgctttaagctctaacagtaaatcacgaagctctgccgcccgctcgaaatcaagcgctctggccgcttctttcatttcgtgctccatttgctcaacgactttctggcgttctttcttcgtcatcttcgccagtttaggcgcggcttttgttttatattcttctttatcctcagcggcctgcgtcgcgcggatcacatcgcggatttccttattgatcgtttgcggcgtaatgccgtgaatttcgttaaagcgctcctgctgttcccgtcggcgcttcgtttcattaattgcgatctccatcgaattcgtgattttatcggcatacatgatgacgcggccttccgcgtttcgtgccgcccgtccgatcgtctgaatcagcgaacgttcagaacggaggaagccttctttatccgcatcgagaatggcgacaagtgacacttccggaatatcaagcccttccctcagcaggttgatgccgattaacacatcatgttttccgaggcggaggtcacggatgatttcaatccgttcaagcgtcttaatctcggaatgcagataattgaccttgatgccgatttccttgagataatcggtcagatcctctgacatttttttcgttaaagtcgtcacgagaacgcgttcattccgttcaatcctcgcctgaatctcgccgatcagatcatcaatctgtccttcgatcggacggacgtcaatgaggggatcgaggagtcccgtcggtctgatgatctgctcgatcatttccggcgtatgctcaatttcatacggtcccggagtcgccgacacgtacacgatattgtgcatatgcttttcaaattcctcgaatcggagcggacggttgtcaagcgctgacggcaggcggaacccgtgatcgacaagcacctgttttctcgcctggtcaccgttgaacatgccgcgcacctgcggaatcgtcacatgtgattcatcaacgacaatcataaaatcgtccggaaaataatcaagcagcgtatacggcgtagagcccggcggacggagcgtcaaatgtcttgaatagttctcgatccctgagcaaaaacccatttcccgcatcatttcaagatcatatctcgtccgctgctcaagccgctgcgcttcaaggagcttgccgttttcgtgcatcactttcaagcgctcctcaagctcctgttcaatattcagaatcgctttttccatcttttccgcccgggtgacgaagtgggaagccgggaaaatcgcgacatggtcacggtcgccgagaatttctccggtcaaagcgtcgacctccctgatccgctcaatttcgtctccgaaaaattccactctgatacaatgttcgtcacgggaagccggaaagatttccacaacgtctccgcgcacgcggaacgtcccgcgctgaaagtcgatatcattgcgggcatactggatatccacaagctttctcagcagctcgttccgctcaatctccatttccggtctgagcgacacgaccatttcccggtattcttcaggcgaaccgaggccgtatatgcatgacacactcgcgataatgatgacatctctccgttcaaacagagaggatgtcgcggagtgtctcagcttatcaatttcatcattaatgcttgcgtctttctctataaaagtatccgtttgaggcacgtacgcctccggctgatagtaatcgtaatagctgacaaaatactcgacagcgttgttcgggaaaaactccttaaactcgctgtacagctgtccggcaagggttttgttatgggcaatgaccagtgtcggtttgttcacttctttaatcagattggacacggtaaaggttttgcccgtccctgtcgcacccaggagagtctggtgttttctgccttcctgtatgcctttgacaagcttctcaatcgcttgcggctgatctccctggggctgatatttcgagactaactcaaaacgatctttcacaaaaaagcctccgtttctttacgaaatcttcctattgatatagtaacacaatgacgggcaaaatcactaaaaatacgaactaaagttcgatggtttatttttaccaagtcaatttttgtataaaaaacctgcttttatggcgtaaaagcaggcattctatttcatattcaccatgtcaggcattgtctttctttttgtctgcttcttttttggccatgtacagccctccggccaccagcgatacgacatccaatccaacgataaaatacgtttcggtgtaaccctttaaataggatgcgaaaagcagtgcggctgtgagagcgatcgccacatagtggttaaacgtgacgcgcgtaaaaaggacgaccagcataaaagggaaacataatgcaaaaacggcttttgtaatcacaaaaaccctcctcgggaattcttcatctcatctgattatagtaaaaaatgaagaatcggacaatcgttcccctgctatcacaataccctttttcggcagtcttcaatcatctgtcaaagaaaatgtgaatataaatccattgaaccattaaccagatgaatcaaattacctttcttcagccgaaaggatgagaaggtttaggcctttgtatctttgacagtttcttcctccctctttacaatgtaatgatagtgtttactatcattttcttggatgaagaaaaaaagggggtcataccgcatgtattcagtgcgatttcaaaaagcggaagaatcgagccgctctgcaggagcaaaaggaatgaacctgattaaactgacgaaaaacgggctgcccgttcccggcggttttatcattcagacgaatgccctgacacgttttatggaagacaacgggcttcaagcagatcaggaacagctggagcgcgccattatgaacggcacgttttcaaaagagcttcgggaggaactgaccgcatcgttttatgaattgagagaatcatacgcctctgtcgccgtacgttcctcctccgcgtccgaagatcttgaaggcgcttctttcgcgggacagtacgaaacctatttaaatatcaaaactgaagaagagtttctcggaaaagtgaaagagtgctgggcttccttcttctcggcgcgggtcagcggttataaagagaaaatgaacaatgacaccgcagaaccgttaatgggcgttgtcgtgcaaggtctgatcaattccgaggtttcaggggtcattttcagccgcaaccccgtcacacatgatgacggagaactgatgatcagcgcgagctacggcctcggagaagcaatcgtctccggcagcgtgacgcccgacacatttatcgtcaataaagacacatttcagattgaaaaagaaatcggcttaaaagaaatgtatatcgtctctaaagacgaaggcgtgacggaaaaagagacgtccgctgacatgagaaaccgcttctgccttgatgacgagagcgtcaaagagcttgccatgctgacgataaagacggaagaactgtacggttatcccgtggatctcgaattcggatttgccgaaaataagctgtatctgcttcaggccagaccgattacaacgatcgcgcaggatcagaaagcggcagacgaagaacgggaatttatcatgacgccccgggatcagaaagatttttggctcaatatggagtccaatatagaaggtcccgtcagcccgttattcgcttcactcattgtgccggctttggaatacggcctcaaagagagcacgaagaccttccctgtgatgggcatcgagattgagcgtgtcaaacttcatcagggccatgttttttccagacagcataagacggacgacaagctgcccgcagaacagttagaagcgcttttccccgtcttggctgaccgcatgtacgatattattcaggaaacctttctgcctttttatcaaaagctggacgaactggcgcatacagaccatacgccggagactgccattgatgcgttccgaaacctgcaagacttctatttaaaaggatacgcagaacatttcaatattgtctttccgcaggttgcgttaaacatgatactggaatctatgtacggacaggttgagaaagaaaacacctcccttctgtatgaaatgctggccggcgtcatgaataagtcattggagaccgacagacagctctggctgctttccggacaagtaaaagacagccctgagctgcggcgcgtctttacggtttctcatgccgatgagctgcatcagacgcttctgcaatcaaatgagggaaaacgctttctcgaacaagtcggcgaatttttacaggaatacggctggagatccgtgaaaagtcatgatctcattgaagaaacttgggcggaaaacccttatttcgctttggccaacattcagaactatgtccgaaacggatacgattttgacagtgagtttcataaaacgatagaaaaacgaaaacagctctacgccgactttatggatagaattgaagatgacggcttccgggagacatttgaccgctattatcagtggacattgtcttcatccgtcatcaaagatgatcaccatttttatattgatgcgatgctggacgccaaagcgcgcctttgccttctgaaaatcggcgagctgcttcaaaaacaaggcgtaatcgatgatcgggaggatatgtggtacttatacagcgatgaagtcgagaaagcgctggcgtcgccggttccgatgcaggaaaaagccgctgaacgaaaacggctcttccagcaatatcaattgcttgaagcccccgcttatctcgggactccgacttcggaacagctgaaaacggctgaacagattaccggctccatcacagaagatgaaaaaaacactgaacatcaaatttacggacttgcagcgtcaagcggaatcgcaagcggaccggtgaaagtcattcgtgacgcaagtgaattttcccgtttttcaacaggagacgtgcttgtctgcaaaatgacgacaccgctttggaccagtctgttccaggatgcaaaggccgtcattacggacacgggcggcatcctgtcacatgcggcgatcatcgcgagagaatacgggctcccggccgttctcggcacacgtgccgcgactgacaggctcaacgacggagatatcgtcacggtagacgggacaaacggcaagattacgattgtcaaacgcgcttcatgctaggtttccctctttattgacgggcagggcgggtgtatacttgtcctgccagtatttacgcgaggtgaaacatgttgagaacgacgaacaagagaattattgacgccgcgatgaatctgatcatccaaaaaggataccgcgcagcgacaacaaaggaaatcgcagaaaaagcaaaagtaagcgaagcaacgattttccgtaattttaaaaacaaacaaggattaatgaaagccatgattgaacagcaggcgccggttccggaaagcatgatcaccaaggcggaaggcgatctgtatgaggatcttcttcatttcgccgcgacccttctgcagcaattggaacaaaaaaaagaagtgttccgcatctgcctgcgcgaaccggaactattcgaagacgtcctgcaggatattgtcgtatatccgcaatccgtgaaaaagcatttaatcgtttactttaaggagctgacaaagaaaaatatgataagccccggcagcgaagaagctaatgcagacgtctttatgacgatgattttcggttattttatacaccggctgcagctggggaaaagagtcattactctctctgaggaaacgatgctgaaacacagcactgagattttcatgaaaggcattaccggccggtcattttccggctccaaggaggatgaaggatgggttcaaagaaagaatgggcgctgatcgtttcgcttttgctgggagccatactcgttcccatcaattctacgatgatcgcagtcgccctttcatccatttcccgctcattcagcgaatcaattgccagcatcacatgggtagtgaccgtgtacttaatcgtgatggcagtgacacagcccattgccggcaaactcggtgatatgtacggtaacaaaaaaatgtatttatggggcgtcggcctttttctcatcgcatcattggggtgcgccctctcgccaagtcttttcttattgattttcttccgggcgcttcaggctgccggcggcgctttgcttacgccaaacagcatcgccatcatccgccatgtcgtgtctgaaaaacggcttccgaaagtattcggctttttcggcctcggcgccgggctgggcgcagctctcggtccgtttatcggctctctattaattgagagcttcagctggcattcgatcttttgggtcaacattccgtttcttgcgatcgcactcgtgacggcattaatgatgtttcctaaatataaagaagaaacgtctgacgctccgcttgatatcatcgggtccgttttgcttgccggaagcattgtatctattattcttctgacgaaaaatgaaagctctttgggctattgggtgtacgcgctgctcattctcgtattggttccgctatttttcaggcgggaactgcgcacgaaacatccgattattgattttgatctatttaaaaacacgacctttacgagcgccaatctgtcggttctgttaagtaatttaatgatgtacgccgtgttattgattatgccgctctttatgaccggccacttcagcatgaacacgtcgcacagcggcatggcgctgtcagtcttttctgttttcatgtccgccagcaactggggcggagctcagctgcatcagaaatggggcgcgcgaagaatgatttttctgtccttcgggctgatggccgcagccaatctcttatttctgcttttggtttattcccattccgttccgtttcttatggcatcgcttattgtaggaggcatcgcgtcaggtgcggggctgactagcatgcaggtatcttctcttgcgacggtagaaccgggcatgtccggcatcgcatccgggattttctccaccttccgttatttcggaagcattatttcttcagcactgatcggtttaatctccgggtttcatattctgtttatcatattgatcggagtttctgtgatcggcttgttcgtatcgcttggaattaagtccggggaaaccgttcagacgaaaaaaagccattcggcataacgaaaaaggttccgtaagcatcagctttccggaaccttttctagttttccttcttcattttctctctcaaagtgtcaccgcactcccccgatgcatagagtatcgcaatgcggtttttctctatgagattctttttatttaaaagagaaaaggggaatgtaaatggctgagaatccagatcaaattcgcccgctggcaccgtctcttacgatcacggccgttcaaaacagcatagaaggaacagcgtcagatctcgttcttacctattcgccgaattccgtgctttcgttaggcggagtcgtattccgtctgcctgaagggtttaccgcgacaacgaatgacatcctcaacaacaataacttaacttcttcacaactatcagaaggcggcagaaaagtcactttgccattgacgcttgatcttctcggacttgcccagttcacgcttgtgctgaaaaacaaaacactcccggcggcaggcacgtataccttttctgcagagaatacagtgctgatcatcggttcgcttctgccggcttccgcgcatcttactgtgaacccggcagcttttgcgtatgtgaccaactatttaagcaaccatgtcggcgtcatcaataaaatgaccggcacggtttcaagtgtcattccggtgggagcagcaccgctgggcatcacgataacgcctgacggcagatttctgtacgtctgtaattcaggagaaaacagcgtatccgttctctcaaccgagacaaatagcgaggtcgagagaatcccggcaggcgcgtctccttataaaatcgccgcttcgccaaacggaaactttatatacgtcaccaaccagcaaagcagcaatgtatatgtgatcagcacacaaaccaataccgtcacctcagtcatccccgtcggccttctgccgacaggcatcgccgtatcgccgaacggacagcttgtctatgtgctgaataccaatacaaacaccgtttcaatcatccgcacgtcagacaatacagtggcggcaaccattattatgccgtacagctccccttcagatgccgtcttttcgccagacggaagcaaggcttatatgacaaaccttaacagcaacaatctcgccatcattgataccggcacaaacacgatcattgataccgtcaattcggagctgaatccgctcggtgtcacggtaacgcctgacggggcgaaagtgtatattttaaattcaagcagcagcaccgtatctgtgctggatacagctgcaaacacgatcaccgcggttattccggtcggtctgtatccgttcagcgccaaaccggcagctgacggaacacgtatcttcgtcacgaattttttcagcaatctgatttccatcatcgacacggcatccgataccgtcgtcggcaccattacgtcagtattgtatccggctgacatcgtaatccggccgtaaaaaaaagcccggccgccgtgttattagcggcaccgggctcttttataatgctgtcatttcttcttgctcgtgttcatcctgcacgaataaaatacctaattcatgatgttcgccttcataggacgcgcgctgatcaaaccggatctcaccgttcaggccgatgacctccatttttacaaatgcgcggtttttttgaagtgcttcataaaaatccgatacatgtttcacggggatgccgtttactttcgtaataatctcaccgatcttcagctcaagatcgtccgcgggtgtattcggaatgatgccgagcaccattaagccctgatcccgcttagagaaataaaacggagccgcgttatcgttcagccgctgtcttaatgataaaaacaggcgtccgagcaccgcaatacaagcggcagctccggcaagcggagtccaccaaagggcagctgccccgaatgcggtcacgataaccccgagaatcatgacgcgtttcgccgttatccttatgctgacttccggaagtgacccctgcacacgctgtccgaagccggcgatataaggaatccagattaaatggaaagagccgcccggcacggtaaagacaggccaccaagaaaggtgtgactccagcccgctgcccggcaccaataagaaaagcggaagcagccatgcgcgattcgccaattgtcggccgataggcaggcctctgctgctgacgacaagcgccggagatgttttcagatgcgctgaacggcaggcagccgctccctccgtgataatcaaaaggcccataaacacggccgccgatgcccaattcacgccgaatgcctgcggaaaccgatccgcaaacggcactgtgtgggtatactgaaggataaacgcaatgaacatgccggcgctgacaatataagctgaggacagccaattcatacggaacgtcagcgaagccaaagccgtcacggccgcgattatgccgagaagaccgaatggaatcgaaattcccagtccaaaaaataatatggagagaagaatacccggtataagtccttttatgtatgtaaagataagctcgtcatacatatccgcgatctttgtatgaaacgtatggcgttcacgtttgatccgcaaatatccgcatgcgagacttatgatgataaaaaaccagaacatcgggtgcaaaaaaaacagaccgatacttttcagaagttcaattccccattgaacagacactgctttcaccgcctcaagccaaacattttaattctattctaccaaataatcattggcttgaatatctcaaacgtctatctctcttccgtcatccacagcgttacatttgagagagagaaatctttcagatagtggtcaacctccacctcgatcacgccgctgatcagaagcatggaccgcttaatatccgtcagattgattcctaaacgtttatggtttttcattaagtaagtgaaataatgcttcgcacactcttcattgatttcgtgaacgcattcaacatttgtgtaattgaccaggtatctgctgaacagcataagaagacttagtgcttttgttgatgaaaatgtgacgtcttttgttctgtcttttagttgttccactaattcataatattttttttcacgcacaatacttgccctcttcaattgtgaacccccatttttttatccagataagcacgggtgattacagctgccgtgctgaagcgccgcaaacacttctgctttcgatactgaaatgcagctgccaaactaaaactgttctctattagaaccttcttttattgtaagaactaaaactgactgaggcaactttcaaaagtttcattttgaatacatattaaatcggcataaagtctctcttctctataaatatcgggtaatgtttgtcctttataaatgtttaaatgtgaaaatttttttaatatcttgtcaaaaccgtcataattatatgtcttttggttcactttttatgaatgacaaaagaaacaggagacgcaaaaaacgcctccttttcatttattttacaaataatgattttaacgccatttgcagctgcaaatcatttttttcgtcagatttcttttcattcatcagctgattcattttttccgctgtctttttatcaatgaccgctgttttatcaagcttgtaccggtcttgaaacgccagaacggcttttttcattgttttgctgaaatagccgtccgctctgcccgggtcgaagcctaggcctttcagcaggatttgggcgtgcttgacatccgcgctgttcatatcaggctgaagcggctgtttcagctgaagcggtcccgccgcaaaataatccggctggctcacagcgattgtcggagcaatgccttttttgtgaatccaattgcccttcggtgtcagccatttgtaaagcgtcaatttaatgttgctcccgtctcccataggcacggcctgctgaaccgttcctttaccgaaagaagtgtcgccgacaacgtcataatgtcccgcttcttttaacgcgcccgcaagaatttctgaagcggaggcgcttcctttatctgttataacattgacgggatacggcttcttatgttttaaggttgagaaatattgttttttatcgccgttacgctccgcaatttggatatacggcatgtcttttgtgatgaaatgctttaaaatttgttcgacgctttgaaggtagccgccgggattcccccttacatcaaggacgagaccgtcaatcccttgtttttcaagctttttcagcgccgcggcgaagtcctcggcggtatgctcggaaaatgtcgatatgccgatgtagccgacatgatgaccgcctgattctttgcgggaagcaaatacggtttcaagcgggatttccgctcttttaatccggaatgacagctgtttttcagtacccggacgctgtattttaatagaaaccttcgatcctttttttcctctgattttcagcacggcttcgtttaaatctttcccgttcattgacacgccgtttatactgatgatttcatcattcggcttgaggcccgctttttctgccggagattgcttaaacggtgatacgataatgattttattgtctttcataccgacttcagctccgatcccttcgaaagaagaatcaagagaatcggaaaattgcttagcggtctgcttgtccatataaacggaataagggtcgtttaatgtagacagcatcccctgaatcgctccttcaagaagcttttctttatctacattttccacgtattcgttcgagatcagctcatatgctttttcgattttttccattgcccgggttctttctgcgtctgatgaattcggctgtgccgccccggcaatatgggctccgccgcacatcatgcttagggccgctatcactgcgatcattttctgcttcatcgtttacctcctcttagtccttttacgaaaacctggagatagtatgtgtaaattgcaaagaattcatgtaacggcaacaaaaaaatgaaaatgcgagattgtttcatatatatgggtaacgtataatattttgtatgcaattcattaaatatacaggagaatgcgatatgaaaataaaattatcgattttatccgcggcggttctggccgcaggcattaccgcctttgtctggccaaaaacagaggccaatgagaaagcgcagacggacgccttgtatgtttctcccgcaggcagcgaccaaaatgaaggaacgaaagaaaagccgttccgcacattaaaacatgcggctgaaaaggcagaggccgggacaaccgtattgattcgggaagggacatatgatgaaacgtttgaagtaaagcacagcggcacggccgaaaagccgattacatttcggaactatcagaatgagcatgtctcaatcagcggcaaatctgcgccaaaaagcgattctgaaactccgttaatccaaatccgcaataaacagtacattaccattcacggcgttacgcttgagaatctctccgtatcatcagaagatgcgacggccatggggatctgcgtcaccggatcaagcagtcatatcaacattgacggcaaccatatccggaacattaaaaccacggctgatgaaggaaatgcacacggcatcgcattttacggcacaggtgccatgaaggatgtcagcattacaaataatacggttgaaaaactgacgctcggcgcaagcgaagcggtcgtgctgaacgggaatgtcgacggatttaagattgccggcaataccatccgggacaataacaatatcgggattgacgtgatcggatacgaaggaacgtccaagcaaaacgactatgcgcgaaacggcgtcattgaaaacaatacggtgagccataactcttcttacggaaatcccgcttacggagatgaatattcagcgggcggtatttacgttgacggcgcagaacatgtggacattaagaaaaacaccgtttacaacaatgaccttgggattgaagccacctctgagcataaagggaaatacgcacgagatatccggattacggataacaaggtgtacggcaatgcatacaccggtatttcaatcggaggctatgacacgaaacgcggcggcaccatcaattcggtgatcgctcacaacatcatgtaccgaaatgacacgaaggaccttgacggcggccagctgctcctgcagtacggcacaaaagggaacacgatcgaaaaaaacatcatgacggcaagcgattcacggatttttatcgcaaatgattttacgaaaaacgaagaaaataccgttaatcataacgtctatcacaaagaagcgggaaaagacggcatctggaattggaagaacagagaatatgattcattcacagcgtaccgaaaaggaacggcaaacgattcggattccatttatgcggacccgatgtaccgtgacgaatcgtcttatgactttacattaaagcccggatcaccggccctgcccgtcattcagtaacgaaaccattaaaaaaagccagtctgtatcagactggcttttttttatacacgaaggaatttccggatggaagtcagacttccccatactccgatcaccgcgccgatcagaatgagcacaagtgatacttgaaacacaaacggactgtacggcagaagtgaaacaaatgatccctgaactttcggggccacccaagcgaccatcgactggtacgtactcagtacgagagcgatcggtatgacagaaccgaatacccccagcagcagtccttccaggaagaacggccagcggataaaccagtttgtcgcgccgacaagcttcatgatttcaatctcttttcttctggcgaaaatcgtgattttaatcgtattcgaaattaagaacatcgccgtgaacagaaggccgatgattaacgcaatcccgatgttgcgtgacaccccgacgatcttaaacagacggctgacttcttctttcccgtatgtcactttatacacatgatcaagcttctcaatttttttcgcgactttcggcgtatcatgcggatctgtcgttttgacgataaacgcgttgttcagcgggttttcctgatcttgcattttcatggcctttccgctgtcgccgaagcttttgaccaattgatcaagctctttatctttagatgaaaactctacgctttggatacccgagatgtctttaatctcattctgcagcgtatcctgcgttttcttatttgacgtcagatcgattaatactttaatttccacttctttttcagcatttttagccatgttgtttaagttcagcataatgactaaaaacacgccgaccaaaatcaatgtaacggtaacggcactgatggatgcaaatgtcatccacgtgtttcttccgagagacttaaaactctcacgcaaatggcgcccgagaattttaatcataagaaccatactcccctcttgactcatcacgcacaataattccgtcttcgatcgcgatgacccgtttcttcatggtgtttactatttctttattgtgtgtcgccatcacgacggtcgttccgcggttattaatctcttccagtgtcttcatcacttcccatgatgttaccggatcaaggttgcccgtcggttcgtcagctatcacgacgtcaggattgttgacgatggatcttgcgatggaaacacgctgctgttctcctccggaaagctggtcgggaaactgccgcgctttatgcttcagctgcacaagatcgagcacttcgagcacgcgttttttaatgactgactgctgctctccgataacctcaagcgcaaacgctacgttttcaaataccgtcaatttcggaagaagtttgaaatcttggaaaacaacacctattttacgccgcacgaaaggaatctctttttctttcacagccgcgagatctttatgattaatcaatatttgcccttttgtcggtttttcttctctgtaaatcattttaataaaagtagatttaccggctccgctcggtcctacgacatatacaaattctccgggatgaatcatgactgacagcccgttaatcgcttttacaccgttcggataggatttatatacttctttcatctctatcatgaaatcacctaatcttttatttatgtcttgcagccatagagttcgcaaacgtacagcggtttatggccgattcgtcaggaaacagatgaaaaatctgaaagttccttttcctcagtacacttcattatacgtcaaatttagacatattactattacagtttcttttcattcccagaccgagaaaaaaccttgcccctataacaggcaaggtttttctgttattttttctgtgacagccattttgcgatcttcgcggcttcctcatcatttacaagatggctcggcatattgccgcgtccgtttttaatgatgctttcaattttagcttcatcatacttcccgccgacttcctgtaaattcggacctccgccgccttctaagtctttaccgtgacagccgatacagctttgctgataaagctcttcgcccgctgacgcagatgcttttgatccgcctgagctgtcagagctttcttttttcgattcattggatccgccacatgccgccagcaggacggacatggtcagaaccagcgccagcagcgcccattttgatttcatatgtaagatgcaccccttcgctattataacctcgtttacgcgcgtttgaaaccctcgccgagcacctcgcttgcgtctgcgacaatgacaaaggctgactcatcaatttgtttgacgatttgtttcagttttgtgaattcggtctgaccgacgacacacattaagatcggccggtcatgttccgtatacccgccgactgcggagatcttcgtcacacccctgtcgatttctttaaacacagccgatctgactgcttcttcatgctgcgtaatgattaaagccattttggagcggttgaacccgacctgcacgacatcaatcgttttgcttgaaataaataccccgagcatcgcatacagtccctgctccactccgaaaacgagcatcgcgctcagcacaattaatccgtccatgatggcaaggcacgttcccagcgacagccccgtgtatttgtgaatgatctgcgccgccagagccgttccccctgttgagcctttgccgagatacacgatgccgattcccgttccgatcccgacgcctccgaaaatcgccgccagcagttcatgggtcgtcgcggcaggtagatctcttgttaaaaagacggcgagcggcagaacgatggaaccgaccagtgtcttcattccgaacttcccgccgagaatgatcactccggcgataaacaaagggatgttaataatccactgcacgtaagccggttcaaaaccaaacgtttctaaaatggtgctgatcccgcttactccccccgctgctatacggttcggcagcaaaaatacgttaaacacgacccccgtaatcgccgcgccgatcatgatatatatgtaatctttgatcagacggagcggcttattgtgattcacatccatgcaaaatcctccgttctccgattttctctcgatagcattttaattcttcccggcttagaagtaaataacagccaaataccgtattaatttgctaaagcgctgttgtgaaaaatggaaaaagagaacggataaaaaaacacaccttgccaaaggcaggtgtgttcccggattacgacagtttagaacgtaaataggcgtcaatgaagatatcgatatctccgtccataaccgcctgcacgttccccatttccgtattggtgcggtggtctttcaccatggagtacggatggaagacgtacgagcggatttggctgccccagccgatttctttctgttcgccgcggatttcgtcaagctccgcctgctgttcttcaattctgcgctgatacagcttcgctttgagcattttcatcgcccggtcgcggtttttgatttgtgagcgttccgtctggcacgtgacgactacatttgtcggcaggtgggtgatccgaacggctgaatcagtcgtattgacgtgctgtccgccggcaccgctcgcccggtacgtatcaactttaatatcttcggtacgaatatcaatgtcgatttcttcattgaattcaggcatgacttcacatgacacgaatgacgtgtgacggcggcctgatgaatcaaatggagaaatccgcacgagacggtgtacgcctttttccgcttttaaatagccgtatgcattgtggcctttaataagcagtgtgacagacttaattcctgcttcatctcccgggagataatcaagcgtttcaactttgaagccgcgtctttccgcccagcgggtatacattctgagcagcatggaaccccagtcctgagattccgtaccgccggcgcccgggtgaagttctaaaatcgcattatttttgtcatatggttcactgagcagcagctgaagctcaaattcattcaattccttcgttaatgacttcagctctttctcaagctcttgctgaaggtcctggtcaggttcttcttttaaaagatcatgtgtcatttgcagctcttcgtgagactcgctcagctgatggtaggagttcacgtattctttcagaccgttcgcttcgttgatgacggtttgggccttctgctggtcattccagaattccggttccgccatcttttcatctaattctgcaatgcgggcttcctttgattcgaggtcaaagagaccccctgaagtccgctaaacgagaagccatattttcgagttctgccctgatttctgataattccattccattcacctcattaaaagatccggggcgccataagacgcagacccggtcatgttcgcttcatacagtccagactattctgtccggccgcagcaatttttatatttttttccgcttccgcaatggcaaggcgcgttgcgtccgatatccacaactttgcggaccggcgcttttttcgcttgtttggcctcatcgccgtcctgcggctgatgagccgtcgtttggccctgaacaacttcttcgcgttccagattgctttcaatctcggccttcatgacgaatttcgcaacttcgtcctcaatggactcaatcatgtgctcaaacattgcgaagccttccatttgatattcacgcagcggatttgtctgcgcataagcgcgaaggtgaatcccttgacgcagctgatccatcgcatcaatatgatccatccattttgaatcaacggcacgcaatacgatgactttttcaaattcacgcatctgctctgtaccgaaattctcttctttttcattatattttgtcatgatgcggtccatgatcatctcatgcatttcatccggttcttttccgaagatatcgctcttttcaagcgcgccttcatcaagatacgttgaattcaccagctccacgaggccgtcaagattccattcttccggaagctcctctttcggcgtataagcggcaatcgcacgctccagagaagacttgatcatgccttccacaatgtcgcgcaggttttcagagtcaatgacttcaaaacgctgcttgtaaatgacttcgcgctgctgacggagcacgtcgtcatattgaagaagctgtttacgtgaatcgaagttgtttccttcgacacgtttttgagatgattccacggcgcgtgacaccattttgctctgaatcggcgtggagtcatccataccgaaccggtcaagcatcgccatcgtccgttcagctccgaaacggcgcatcaattcatcttccattgaaagataaaattgtgtgatgcccgggtctccctgacgtcctgaacgtccgcggagctgattgtcaatccggcgggattcgtggcgttccgtaccgacgaccgcaagaccgccaagctcttttacgccttcgccgagtttaatgtcggttccgcgtcccgccatgttggtcgcaatcgtgacagcgcctttttgtcccgcttcttcaataatctgagcttcacgctcatggtttttggcattcagcacctggtgcggaatccctttattcttcagaagtttagaaatcaattcagacgtttcaacggcaaccgtaccgacaagaaccggctgtccggtcatgtagcgctgggcgacatcctccgccaccgccttgaatttcccttccattgagcggtagatcaagtccggacggtcgtcacggatgaccggctggttagtcgggatggatacaacctgcatgttataaatattgcggaattcttcctcttccgtttttgcggtaccggtcataccggccagcttttcgtacatacggaaatagttttggaacgtaatcgtcgccaatgtcatgctttcattttgaatctccaggccctctttcgcctcaatcgcctggtgaagaccttcgctgtagcggcgtcctttcatcagacggccggtgaaggaatcaacgatgacgacctggccgtcctcaacaacataatccacgtctttctgcatcgccgcatgggcttttaaagcctggttgatatggtggttcaaggctacgtttttgacatcaaacaggttgtcgatgccgaacgttttttcagccttcgtcattccttcttccgtcagctgaacgcctttcgttttgacgtcatacgtataatcctgatctttcttgagcgtgcggacaaacgcatttgcctgcacgtacagttttgtggacttctgagcttgtccggaaataatcaatggcgttctcgcttcatcgactaaaattgaatcgacttcatcaataacggcaaaatgaagcgggcgctgcaccatttgttctttatagagcaccatgttgtcacgcaaataatcaaagccgagttcattgttcgttgaatacgtgatatcggcagcgtaagcttcgcgtttttcgtcttttgacattgaattcaggttcaggccgactgtaagcccgagaaacgcaaagatttctcccatttgctgggcatcacggcttgccagatattcgttgaccgttacgacgtgaacgccttttcccgtcaaggcatttaaatacacgggaagcgtagacgtcagcgttttcccttcccctgttttcatttcggaaatgttcccctcatgaagggcgatgccccccatcagctgcactttaaacgggaacatgccggttacgcggcgggaagcttcacgaacgacggcaaacgcttcgacaagaaggtcatccgtcgtttctcctttttcaagccgctctttaaattccgccgttttatttttaagcgcctcgtcagaaagattttcataatctcctcttacggcatcaatgtcatttgctattttttcgtatttgttcagcgcacgtttggtcggatcaaacattttatttaaaatcccaagcatctataacgctcctctatgttcacatgcagattttgcatggaataaatgataattttctgtccatgtatacctctcattatcataacataccttttgctatttccaaagaatttgcagataaagatagagaaaaaccttccgcgcgttcacggaaggctggatgggtttattcagtcggttcaattaatccgtatttgccgtcatttctgcggtaaacgacatttgtgagattcgtctccgcgttggtgaatacgaagaaattatgtccgagcatattcatttggagaatcgcttcttcattatccatcggttttaaattaaaacgcttttgacggacaatttccgggctgtcatcttcaatttcgtcctgaaccgctacgcccgtatcagcagcgctgccgttctcgaaataatgtttcggaagaccctgctcgcggaattttcggttgacttttgttttatgctttcggatttgacgttccagcttgtttgttgcgagatcaattgcattgtacatatcctcgttatgcacttcagaacgaagcgccagatcagtcatcggaatggtgacttcaactttggattccttatcgttatagaattttaagttgacgttcacatcggcattgacgctctgctcgaaatatcgttccagcttgccgatttttctctccacatgatcctttaacgcaggtgtaacctcaatgttttctcctctgatattgtagttcatcaaagaacgcctccctttatctaaggatatgtaactatttctcttttaccccttctgatccctgctgaaacgttaaaataatgtgtaaattcggtgaacgatgacgaatggtgtcggttttatccggcagcgtccggcaggattataagtatatgcaaaggacgcaggcaaaagacctgccgcttgcagcaggtctagtgaagaacatacggtttgatgcagtcgtgcgtctgctccatccatagcttataatgcggcagaaagatggtttttaaaaactcctgaaaaggggcggacgggaaatcataatcatttaacatgctgaaatcctgaaagatctcgtcaaatgagcggatcgccgtctccacgcatcggcactcaatgatagacagcagaagcgcatgagaagaatcgagatgaaaaaaagcctgaatcaaatcgttgtaaatccgctcgccctccgtcttaaaaaaatcgtcctgcgtgtccaacaggtagcaaagcccctcatcaatcgtaaaaagaagctggtaataggctgacaccaaatggtaatcgttcaaacttctcaaaacactcacctatttgcgtttgtcgtaataacggccgtcacttgtcgtttgctgatacggattgaaatacgtattatggtagattcgttttttcttaagcgtttttatttcatttcggataccatcctgaatccgtttcacttcgccggtaatcagacggtccatcgcggccacctgctgaagcagcgttttttcttcttcggaaaaaggcggctttatgcccgcaagcatctcctcccttttctccgtaaatgccgtaacgctgctgatgagaccgtcgctttccggggcgtccttcagtgcggcgtacatgttcttcgtttcgttatacaaagaaaagacattgctgttcatcaggcaaggccgcccgcgccatggctgtttttccgttcactctgcatggcctgcttccacgtgtcgcgaaattcagtaacgagcttttccgcctcatctaaaaactctccgttattctgcacgttcgcgtcgatcagccggcggcggatgtaatcataaatggatgacatctgctcggaaatctcaatctcccggtttaacgtgatgctgagctcttgaatgatgttttgcgcctttacgatattttcatttttggcttcaaggttgttttgcttcatcgcctgccttgccagcttaatgaatcgcaggcagccgttataaagcataagggtcagctcttccggagcggctgtaaagacggatgtctgctggtaagcagcaaaaggattatttattgccatttttataaaacccccaaggttatgaagttgaagatcctaacattgacgtgagatatgaagattggctgttcaatttctccaatgccgtatccagtgcgctgaactttttataatatctcgtctcgatgtcatccagcttcgttttcatattggaaatatttgtttctatttcatccaggctttttccgatggcaaagctggttgataccgagctttccgtacccgcctgttttgaaatttgaatctgcattttgtttaatgtgtcttttaatctccgggcaatcccctgttcctccgggtttttggttttcgctgtatcagggctgtctgcattaaacagtttagccacgagagcaggattctcggtaattttctgtttcagtttcgcttcgtctttaatgacaagctttccttgatccgtataactatcagacgtctcaattccgaaatcggcaagctgatattttttcccgtcaatcgtaaccgttgagtacagatcaagccgcatctccgccaaaccgttctgcagcgtgctgtcgctccgtaataaaccgcttttggcttttgcctcccactgctcaatctgcttatcggtcattgcttctctttgttcatcggttagcggcttataatcacggtattttgattctgtcaccttctcatttgcgcttttaattaacgtattgtatttatcaacgaaatctttaatgttgttaaaaatgccgtccgtatcagtcgtgctgttaatcgtaaccgttttgttgctgtccgtcacgctgttcagcgtgtatttgatgccgttgatcgtaaagttatttgacgtttttgtcatttcaagcccgttgaacgtaaacttcgcgtttttcccttcggcattggccgtcagttcatttgttgcatcatcaacggcaaaaccgagctgatctttcagaaagcttttggtcgcgtcatcacctgctgaaagggtaaacccttcccccgttttattggaagtgaacgcaatcgtgtccacataatccgagccgttagagattttctcttttaaagccgtcactccgagacccgagctgttcagtttagaaatgacatcgtcaatcgtatcggttgcggcgatcgtgacgtttacctcagtcggcttcgtttcccccggatttgtgacattgaatttcaatgtttggctttgacccgaagtgaaattgatggcccctgaggatttataagtcgtcggcgtagccagctgctgtacagacatgctcgttgaaatattctgttcggcactgacggccaccgcgctgacactggaatccgaacttgttactgtttttttattccagtttgtggacatcagcatattattaaatgtagtagaatacatgtcggcaatctgggtattcatttcccgataagcatcgcgcttccattcaagcgtctgcttttgctggtttaatttattaagcggctgcttttcggcatccatcatttttttcaccagagaatctacatcaagaccggaattaaggcctgtgattcttgtgaccatatgtaccctctccttttcggcgtttagtcgtagacggctctatgacaacagtgagtttccgactgtttatcatatcacagctccataaatgtatgatcttattcttatatcggtcatattaaaaggttttcaataatttaactgcaaaatataatgtttcattttgtcaatagggttctttggcttgctgaaggaggagttagctgaagaaataaaaaaaaagaccctggagaaccaggatctttccgtcattaacctttaagcaattgaagaacttgctgaggctgttggttagcttgcgcaagcatagcttgagaagcctgagtaaggatgttgtttttcgtgtactccatcatctcagaagccatgtctacgtcacggatacgtgattcagcagaagtcaggttctcagaagaagtaccaaggttgttgattgtgtgctctaaacggttttgaaccgcaccaagtttagcgcgctcgctagatactgtgtcgatagctgttttgattgttgtaagagctgaagacgcagctttagctgaagaagagatgtcgataccttttgttactttagaatctgcagctaatttttcagatgcaataactttaccgccagcatcgtaataaccagccggtttgtttgtagcatcgtctgcatccgcccaagtagcagtgcttccgtcagttgctgtaagtgtattttgatcaccagatacagtataagtcgtaccaactttcaggctttcagagtccattttattgatagacaggctcattgtttggccttcgttagctccgatttggaacgtcaggttttgcgcagttccgtcaagaagtttcttcgtgttgaactcagtgtcagtagagattcttgttacttcagacgctaattggtccatctctttttgaagctcagaacggtcagaatctgtgtttgtatcgttagctgcttgtgtagcaagctcgctcatacgctgaagaatgctgtgagtttcgttcaatgcaccctcagatgtttggataagagagattccgtcttgagcgtttttagacgccatgtctaaaccgcggatttgagaacgcattttttcagagatcgcaagacccgcagcgtcatcaccagcgcggttgatgcgaagacctgaagataatttttccatgttttttgcagcagagtttgaacctgcattcagctgacggctagtgttaagagccgcgatattgtggttgattctcattttgtatttcctccctgaattgtttttcgcacgtccttgtgcatttgcgcagcgtcatttctgaagaaaatttttcctctcattggctacaatatatatatcggacggccgcttccattgtttatattgaaaataaaaaaatcctcactttttttgtgaggataagttaagtaataaatcagtattaaaagatacggctctgttgttctcttccaggatcgacaagtagatttctttccggtgaatatctacgtgctgaggcgcttcaattcccagcttcacttgttctccttcgatagcgatcacctttatttcaatatccggcccgatctgaatggactcattcacttttcttgagagaactagcatgatcctcctcctatcagatgttttgtttcataggaagcatcatgtaaaatgatttgtttcgccttcatttcctttttattgacgataatcggcgcttttaaattggcggtcgtgttttcaaaaggctcttccagcgttaaaatcgccatcacttcgacgtcctctatatcttcaatatgcaaaagctcaagcgtcgcttggtcaatgtcaaattcgtaccctttaaagaaaataaacggactggcgacaataaaggcgatgtgctcctgtttcacagactgcagcgccaaaaacggtgaatcttccgacaaaggaagaacaacaaattgagtctcgtcattaaatcccggcaggccgttttcaaatgagataatctgcccttcatctattctgatttctccgtgatattttgttttaattatcatgcttcacaatcctttaccactttcatcttttattctgcgttgccatcatcaatcgaaatcgtcaccttagggtcttgcatcatatcaatctgaactttccccggcgtataattccatacaggtttattgacggctgcttcaattgaaggtttgcgggcttcaatatcaatcgtaagctttgaaggaatgcagtcaatgtcgacgagaaactgcgcaggcagaaagtcgctgaattcgccaaatggatcgggcggcctgacatctgctgcctgccgggccatcacattgcccgttttcttttcgatagccgccatttccttcccttccctgactgtttttgcgataaactcgctgcaggcttcagcacctttttgagcggcttcagcgttcagcttttcaaatgatttgagattcaagttctcccacgccctcgtctgatcaatcgtcagtttggccggcgtgctttcaatgttcagctctgccggcggctgctcgatttccaggtcagcgggcggctgttccatctcgatttcttccttttgaaaggttataccgattttagcaggcacactgtcaataatcaatctcggcatctgcacagagatccctcctgtttatagtattttagtaaaaaaagcgatctccctgttgtgagtcgctttttttatatattgaagacgatagttatattatttcaggaagtcgatcagtgacggctgaatgatattcgcattcactgacagcgctgctctatgaaccgtctgttgagataaataatcaacaattacatcttccatttctacatcctcattatccgacaatactttttcagcggttgccgcttgtgattccaatcttgtctgaatgagttccaaccggtttgtgcgtgcgccgatattggatttttcagcattcattttgtcagtaaaaccgtcgatatctgacagaatttgatttgaatctgcttcggacagcgtgcctttgcttaaagaagcttctaaggagttgagaaattcaaatatattatctccattttgtgcgacgcctccgaaagctgagtttggatcagaattcactttcagcactgctccgtttgagatgttgatgttaacatccgaagcaccggtataattctcatagttgtacgtatatgtgccgtcggcattttcagtgatcggcgggacatctgaattcgttccgttaaacagataacgtccgtttacctgagtattcgcgacagaaacgagctgctttttcagctggccgatttctgtaccgattgctttcaattctgtttcaccgttcgaatcacttttcgcctgaaccatcaagtcccggattttccccataatatccgtttccgagtttacgcttgattccgagttttccagccatgtaaaaccttgcgaaacattccgttggtactggtttacctgcgcaagctgagtacggtactgcattcccttcattgcgacgaccggatcatcagaagctttcgtgatttttttccccgtagacacttgctgctgaagccgatcgagcttgtcataacttgagccgataaatcgaagagaattttttgcgatcatcccttgagttactctcatttacttatctcctatcttcctccggtgcccataccgttaataattttatcgaatatttcatcctgcatcgttatgatccgcgcagccgcattataagcgtgctgaaactgaatcatatttgtcatttcttcatctaaagacactgcactgactgattgtctccgttcatcggctgaaagggtgttgctttcagagttgttcataagattagccgctttttgtgaattaacgcccagctttccgataagggattcataaaagtcattaattgtagtggtttcaccgttaatagtcagcttgctgttctgtacggctgcaagatttgtcgcgtttgtgccgtcacttttttctccgtttaacgacgctgcgatattatcagtagacgcaaggattttgtcactgacttttattttcgctgccgcaccttttgccggcaccgcttcatcaccgctgaaatcaaaaaatgctgcaccctgttcgcctgtataggtcttccctttttcatgaactgcattaaacgcgtcagcaaaggatagcgccatattgtcaagagccgtcagcatttcaggataaagccctttttcttctccgtttgacatatagccgtatgattcaataagacctaaaagtgagccttttccggtaaatgcatccgcattgaccgtactgctgccgactgacacactcgacacgagtccgctgtccttgtcgtagttgattttcatttctgaaactgtttttgtgttaccgtcgagcagcgttccgagagaattgttgttcccgttcagcaattcgacgttaaccgtgccctcagcagtcgccaaggcatgtccgcccgacttattatatgaaacttttatatttgccatagaagataattgatcaatcaatctgtctctttggtcatacaaatcattagggagcataccgctcggctcaactgccgctatttgattgttaaggtcattcagctgattgagaatggaattgacctgatcagctgtgttatccaggttctttttaatatcaccctgaatgttagtcaaagaggtagatatatagttaaaactttcggcaagagatttcccctgctcctgcaaaactgagcgcgctcccgtattttccggattcgtcgccagatcctgaagggcattccaaaatgaactgagcgatccgtttaatccgttattgtcaagctctttcatgacgccttccatttgcgacaatgaattggaacgggctgtatagtaccctaattttgtattttccgttctgtactgatagtctaaaaaactgtctctgacgcgctcaactgaaccggcttttactcctgttccgatttggccggccgtcagatcactgttttttgataccgcgggataagggctcgtcgattgtaatgtgacgcgctgcctcgtatatccttctgtatttgcatttgcaacgttatttgaaactgtgctcaatgcagtctgctgcgcactcaatgcacgccttgctgtttcgagccccataaaagtcgatggcattgaaaatcctccgttctaagcttttgaatcgaataatgtcaaacggctgacaggcttgcgcgccgcttgcggctctttataattcatattctctttttcacccggcataatcatatcgaatgccccggagatgaattgtaaagcctgaatcgtgagctgtttgttcatctcattcacttctttcagacggtcaagaagcgcagacagagagtgaaataacccttcaagctcctgtttttcactgcctgaagttctggagatgcatgcagcaattgtattgtcctcaccgcggctgagaaactgagaagttaacctgattcgttcttcctcagtctgcccgattgcctgaatatacttttgctctttagtcaatatgttggagagctcttttgttttacctgctttcagcgcttccgttttctcctcagacagcgtgagcagatgttcatgcagtgcgcaaagtcgcttcagttgatcaataattggctttgcagacattgactttctcctttttattgctttttataaaaattcactatgttttcagcgatgctgtttgaatctattttatatgttccgctctctatatccgctttaagctgagcgattttttcctgacgtgttttagtgaccgcatctgacgcattttgaagctcttttgcatgagaagaaatttccactttgtccttcggctttgcagcctctttttgtacggcttgcttttcgtaatttttttggtatggattaacggattgtgttccgtactgattgattttcataggattcctctcgctttctgttcgcagtctaattcttttatcgactgcgttatcagttagtttagggaatcaggtgtttttggtattataggcatagtatgtgtcttttgtactgtttttttctttgaattcagcggctgttttttggttcatatggtctaattgtgactcaatatctgtctgacaggacttgcaaaatttccccgtcctgatcggatttccgcacctttcgcaaggatatgccaaattcggaagctggctgatctgaatccttttttgtttgataaacttgaggatcagctcttcatccacacctgtttcctcagtgatctgctgcatcgtcgactgtctgttgatctgctttctcaaaaatttatagacggtttcaaatgctttttcttcttctttaatacatgcctggcacacggtctgcaggttcgttttaaaaaataaagcattgcattttggacaattcgccaattcacccatcgtattaactcctattccttctttaatctgccttatatttctatcaattatatcggcagaaaaaaagaatgatttagctcctgattaaagtaaaagaggagaccgatgacgctttacccgctgtcagcaggacttcggcggcttgatgcagtgtggcgcccgtcgtataaatatcgtctattaagatgacgttcataccttcggccgagttttcggctgctgaaaactttttttctgcggacagcctttctgttttgctctttttggattgtttttcattgttcagtcggatgagggggaaaatgacgggcattccgagcagagaggccagcagctcggattgattgaatccgcgttccgccagccgttcgccgctcagcggaatagggatgagagtatgtgtatttgatggatatgccgctttaaagccggcagcaaagtcacgtccaaatgcttgaatgattttcgcatcacccctgaatttaaaccgggctaatgagtccttcatcgcatcattatacaaatataccgaacggttttgccgcagcaaaaagcgcttttccgtttttgattcccgggccgcacaatcagcgcatttttcatttgactcctgaggcctcccgcatatactgcatacggggccttcaattttttcgaatcggctgctgcatatggtgcatacctcttgctcgggcgccagagaaaacagagatctccaagtcaatgaacttgaaattggtgagtcacacaataaacaattcagagatattacgctccttcccgagtttcacagaactcgcttggattaaccgaaacaatcgccgctgattcagccagaatgacaagcagcgccgtatttttctgtttatcaactatctctgcttttgcataagcaactttctttttatctgtaacatatgccggctcagcccggtttaatgaaagtgccagtacatcatttttgcatacccggcatgtgcatttcatatgaagcttaggcatatggcggtcgagaagttcctttaatatgatttctttagaattgacaagcatgctgacagctcctcataggaaagtatgagtatactgtatcatgttttctgaaattaactagtccaacaatttacttttttgtgccaatttgttcataagttctatatgtttttttgcttttttcattccgtttgtcattccgaaatgaaacaggacgacatcaccgctgaaatgtttataatgccttcccgttctgcccgcgatctgtacgagcgcgctctcagtaaagataggtgcttctgcgccgaggacacatgtctgaactttgggcacggtaacccctctttctaaaatcgtagtcgttaccagcagatcaagccggccgtctctgaatcgtttcactttatcctttctgaatgtgtcttccgcatgtacgccttctgcccgtatgtttaatttctgaaaataatccgttgtctttttcaatacgtgtacagacggaacgaataagaaaaccggcagctgtgattgaagtttttggcggacccaatccgttacagagcgcggcagttttcctttctgaagcttcttcttccaattgccgcaccacaaaaaacgcggctccgggaggggtttccgatgatatctggccggtatgcgaacgcttttcagcaaacctgcttcagcattcttttttaatgtgtcagaaggagttgccgttacataaacaagggcgctgtttttcttcctcgctttatcaacagcgaaccttaatgtctcatcggctgaaaaaggaaacgcatctacttcatctattatcatgacatcaaaaatgtctcggtagcgcatcagctggtgagcggttgaaatcatcagcggagtcaagcggcctttgtcctcgctgccgccgtacaaagcagaaacgtcgactttctcaaatgcttttttcagtctcggcagcagttcaagtacgacatctgtacgcggagtcgcgacacagacgcgcaaaccttgattcagggcatactcgataccaggaaacagcatctctgttttccccgatccgcaaaccgcccatactaacagctcttgtctcccttttatcgcatctgtaagcgcggcggcggcctgcttctgtccgtctgtcagtgttccttcccaagaaagctttacaggcttccatctgttttcaggggcttgattccaagaatataatgatgtcagttcatcagcccttcccatcatgacacaggcacggcaataggtaatctgcctcttggcagagggcgcccaaaatgccgcaaagcaggcttgatcagactgaccgcatcgttggcagacgtaacggtttttccggcggatgattgacggctcggccgttatatgctctttttctataaaacgcttgatgcaatgatctgaaaacggtatctcagatctcaataaatgccggccgtaaaagaaatcccgcacctctgaaaattctgaagcaccttcggccatctccctgcctcctttctgctcaaagtatgcctgccgagaatttttttgtcgaatcacgaaaatttaataataaaaaaatctccgcccttgaaaacggagattttcacttagtttttaaagcaccagccgattccgatggcgccttcgcccaaatgggttccgatcacggcaccgaaatagctgttatagaattcgacatgaggatatttacagcttaactcctgtataatatccgccgcttcttcttctctgtttgcatggatgacagcggcccgcatcgggattcctttacttgcatcctccccaaacagttcaaaaattctcgtaatcgcttttttgcgtgtccgaatcttctcaaaaggaacaattaccttattgtcaaaatgaagaataggctttacctttaacagacccccgataaaagcctgagcactgcttagacgcccgccccgctggaggtgtgataaatcatccaccataaaatacgcacggactgtttttttcatttcttccagctctttaataatctcttccggtgagtcaacaccgtctttaatgagctgtgctgcctttaatgcataaaaaccttgcgccaaacagctgatctctgaatcaaagggataaactttaatatgatcaaccatagtgtttgccgaggcggcgctgttataagttccgctgattccgctggacaaatgtatgcttatgactgcgtcatatgttttgcccagttcttcgtacaatgcgattaattcaccgaaagaaggctgggacgtagtcggcagctcatcatgattttttacttctttataaaaacttctccagtcgagttctgtttcttcgcggaatgttttttcaccgaaaaccacttgaagaggaatcatatgaatatgatgttcttctctcatctctttcggaatatatgctgtactgtctgttacaactgcaatcttcatcactttacctgccttattaagtacttaataagtattttaatagatatgaagctgtaaaaaaagacttgcctattatggcaagtcttctcatacatgactaacgcatctctacccagccgtttttaatggctacgacaacggcttgtgtccggtcattaacgttcattttctgcaaaatattactcacgtggtttttcactgttttctcactgataaacaatgattcaccgattccgcggttgctttttccgtctgcaagcatttgcagcacttcacattcccgtctcgttaatatatgtaatggtctccggatttccggataaacctcatgctgaggatgagcagaaactccgcttgtcgcaagacggcggaattcgttgacaagattgtgggttactttcgggtgaaggtaagaaccgccctcggctaccactttcactgcttcgattaaagtatctgcgtccatctctttcaggagatagcctcttgcacctgtttttaaagcatgagtcacatagttttcatcatcatggatggagaggataatcaccttagattcagggtacagctcaacaagctgtttagtagcctctactccatttacattcggcatattgatgtccattatgacaacatcgggatgataatgctcgacgattcgagccgcctcatctccatcgtcaccttctgctaccacttcaaaggtaggttcaaaatccaatattctttttacaccctcacggaatagttgatggtcgtcgataataacaatatttactttagtcacacgctacgcctccttatcctattgttctatatacgccgctgttcggtcaatatgtcttttggctctatttaacaaattataggccgagagataacggaaccttaatcatgataaatgtcccaagacctattttagagtctatcgttatcgttccttcaagcagatctactctttctttcattcccagcaagccaaatgacttgtttttcttttgtttagcatccttaatatcaaagccttttccgttgtccttaatgataagaacgacaaaatcagcggttacttccacttttactgttatttcctctgattctgaatgtttgagtgcatttgtgacggcttcctgagcgagacggaaaagcgccacttcaaattgcggggcaagccttttgttctccgtgtctccgatacactgaaaatgtattttcacctttccgttgtattcttcagttgtataaagatattttctcagtgtaggaatcagcccgagatcgtccaatgccatcggtcttaaatcatatataatccttctgacttcgtaaagggcattccgcacattctgccgaagatttctgatttcctgaaatccgtcctccgtgccgcggtcgcggaagatccgttcaattaattccgatctcatcatgacatttgccagcatctgcgcgggaccgtcgtgaatttctctggaaactctttttctttcttcctcttgggcttcaatgattcttaagccgaaatcttgtttagcctgcgcatcggcaagaagaagccctacttggcgaaggtcttgattcaggtaattcagaacgacggttatttggctgaccaatgattctgaccgttcaatgatttcctgaagccccaaaagccggcgttctaaatcatctctgcgctcccgcagctgcttttcacgctgctggatcatcgtcagttccacttgaagtttgtgcgccttttcataggcgttgcgaatttcttcttcgctgaacttatggaaatttctgcttacttcagacaagcggtttcgtgcgtgccgcgtatgaacttcaagtttgtcccccagctcaatgacttcgtacacctgctgtttgatctgtttgagttcttcaaccagctgctcatattgctggcgcgactgctctccgatttgaaaaacctcgtccttgctcccgtccacggttttcagcattttcataagtatagaatccaaaactttggagtccatcttcgatttattcatctgtctccctccgtaacggtgttgttatgtatttttattataaatgtaattgaactgcaatttatgtcgaattataatgaaagaatgcgtatattctagaaaaaaacatttttatatagtatcttactctttcatgataccaaaatatgcgcaaaaattctaaagtctgttcgaatttgtagaaacaagtcttttaatgcttgtcaggagggtccagcaatcatgctgcacagctatttaactgttaaagaaacgggtgaacatgagattgtgattgaaaaatcacgttttatctgtcacctgagccgtgctgcttctgaagaggaagcgcaggaatttatacaaaagataaaaaaacagcactggaatgcgactcataactgctcagcttatctgatcggcgaaaccgaccatatacaaaaggccaatgatgacggagaaccaagcggcacagccggcgtccccatgctggaagtgctgaaaaaacgcggtctgaaagatacctgcgcggtggttacccggtatttcggcggaataaagctcggtgcaggcggattgattcgtgcatatgggaagtcagtgtctgaaggcttaaatcatataggagttacggagcggaagctgatgcggattatgcatacatcagcggattatacgtggctcggcaagatagagaacgaactgagagaatcagtttttttactgaaagatatccattatgcggatcatgtcgaatttgaaacgtacgttgaagaaaaagacaaagaagcgtttctaaaatggatgacagaactgacgaacggcaagagtaagaatacagagggagaactgacgtatttagaaacagacgtcagccctaaaggagactaatgtaatggctgaacgtgtaagagtgcgtgttcgaaagaaaaagaaaagcaaacgaaagatcatattcaaacggattttgctgctgcttaccctcgttttgttagttgctgccggatttggcggatacaaagtatacaaaacgatcaatgcggcagataatgcatatgatgccctttcccgcggagacaaatcaaaattgcgggataaagtcatcaatatgaagaaaaaaccgttctccattttgtttatggggatcgaaaattatgccaccagcggaaaaggcggacgatcagattctcttattgtcgttacccttgatccgagaaataaaacaatgaaaatgctgagtattccgcgtgatacgcgggtgacgcttgccggcgacacaaccggcaacaaaacaaaaatcaatgcggcttttgctaagggcggagcggatgaaaccgtctcaaccgtcgaagacttattaggcataccgattgataagtatgtcactgtcgacttcaatggctttaaggatgttattgatgaagtaggcggggtcgatgtaaaagtgccgtttgacttcgacgagatgagtgacgtcagtaaaaagaaacggatctatttcaagaaaggaaacatgcatttgaacggtgagcaggctttggcttacgcgcggatgagaaagcaggataagcgcggagacttcggccggaatgaccgccaaaagcaaattttaaacgcactgatcgaccaaatgtccagagctggaaatattgctaaaatcgataaaatcgctgaaacagcgagcaataatgtccaaacgaatatccgaatcactgaaggactcgctcttcagcagatttacagcggctttaccagcaaaaagattgatacactgaccataacaggatcagatttatatttaggcggaaccgcaactacgcgcggaacatattatttccagccggatccaaccaatctcgagaaagtacggcaggaattgcagaagcacctggattacccgtccggaaacagcacggcatccgatcccgcttctgacagcaccggaacggacagtacgactgattcaacttccgacagcacgggaacaggcggtacggctgattcgacttccgggagcacaggaacaagcgccacaaccgattcaaccaacggtactgcaggtgcaaacggtacggacagcacacagtccggcggcacaacaggctattaagagtaaacccgatcctttgagcaggatcgggtttttctatataataagagaatagcaaaaaagcagaccattcgcatgatctgctctttttaatttttctttaccaatcttttgtaaaacttggtaaatggtttaaattgttcatttactaaccctgtgacctctgctatgatttgcataaatacaatcaatacaaaaataataaacagcgaaagccaaatggtcgcgcttttcagcaggatggcactgacactgaaaataaagccgattaaataaatgataatgacagccgtgcggtgtgacagcccgaaggccatcagccggtggtgtatatgtgacttatcaggcgctgagatcggctgtttgtttaaaatccgcctgatgacggcgaatgtcgtatcaaaaatcggcacgcccaaaatgatgatcggaatgatgatactgaataaagtaacacttttataaagacctaataatgagagtactgagatgacgtatccgagaaagagcgatccggtatctcccataaatatctttgccgggtgaaaattataaaataaaaatccgagtgtgcttcctatcacgacaagtgaaagtgacagaataaggattttccctccggacaacgccataacggcgatagtggagagtccgatgaccgacaggccggcagcgagtccgtccaaaccgtcaatcaggttcatcgcattcgtaataccgacgatccataacacagtcagcgggtaagcgacccatcccaattctaaacgttccgttaaaaacggtacggagaaaaagtccattttcagtcccgtgctcacaatcataatggccacggccagctggacgaaaaactttacctttgcgcttaattggtatttatcatcaaggattcctaaaataacaataataaacgcacccaccgtaatggcggtcattttcgtttcattatatatgccggccgcgagcacacccgccgctacgccgataaagatggccaagccgcccatacggggcattattttatcatgtacttttcggttgctgggctggtcaactgcacctattttgatcgcaattttttttacgataggagttaggattaaaaccgttagcagagagacaaaaaacgcaacaactatgcgaaacatgcgttcgtcaagcataaagaagtctcctttggaattatatgaagtcttttctgatattgaaccgttccttccattataattcttactagttattataacaagcatcatcaaaaagaaacactcaaatcaaaaaatgcgctttcccttttaatgggattgcgcatttttcaatatacccgtgcattcgagcattcggccgaataaaacattccaatcccgtccccgggccaattcacggcgcaaagcctcatatgatccgctgcggtccgctgccagaagcgcttcgcaggccgcgatgaaatctgcggggtcgctcccttcaacgtattcataaacgtaaggccttttgatttttgacgtagaagaaaggttgcagccgacaaccggtttcccggcggctaaaaattcaaaaagcttaagcggaaataccgcgtcattataaggtgaatttttatacggcatgatgccgatgtcgacaagctgcatataggacggcacttcattcggcgcggcaggtcccgtccagatgacattcgggcgttccagaagcgactcgaaatccggatcgtcctgagccgtgttcgggcccaccaataaaatcgtccagtcaggccgcaaatctgccgtttccgccataagcgcaaaatcgagcttcggtttgattccgccgataaaaccgagaaccgttccgtttcttcctcgtaaaatgtcttcatccggctgtttattttcccgtgaaaacaggtcatattccactccgttttcaatggtgaacactttctggtgcgggttctccagctttttcccgacctcccggtgcagacagtcagatgtgcaggtgatggaatcggcacgctgaataattctcatttccgcctgtttaatgatgtttcttcttacatttgacagcacaccggcccggccgctgatcggagcggcccacagatcactgcaatcgtaaatcacttcatcccaaggaaacagatctgccagaagcggaaaaccggggaaggtgtaccataagcagcagcgggccccttctccttcttccttcagcatgtgcaacaatggtgaaagtttatgcctgtaacacatgtctgtatacctgccgaaacggaatgctttttgctgcatgagatcctttacagtgaactgccggattccctcggcgatcccggccatctgatcatcattggctcgcggggacgggcatacccaaatgacgcttttcgtttctttttgccgggcaagaaattcagccagccgatgccgtctgtatctcagccggtcatgcccccattccgccgctccgacgattacgtgaataatcggttccaccttcatcacccagctcctctgacgcctacagtcttttcaagaccgcgtttttcgcatattgcataaaacaccacgaagccttgataaaatgcaggcgctcaatttctctataaacaaaccacgttttttttgcggctttccacttgttgcttgaaatcgaattctgcacaagcctgtattctgaaaggcactcattcaggccgtaagccgtaaatccccttttcagcagggaaagccatgtcgctaaatcctgccgcgttctgatatcaggcatttgaatctgccccgtctgctctctgtcaatcatgaccgttaaacatccgataatcgtgttttttaaagcttcatcatatgacaggctttcaggggcttgaatcgttttgtccgtcggcgttccgtcctgctccatgacgctgtagcccgtaaatgaaaaagcgcaggaccgctctgccataaacgcaagctgtttttgaagcttttcctttttccatctgtcatcgctgtccagaaatgcgacataacggcccttggcatgtttaagggctgtatttctggcagctgcggctcccccgtttttatctaaataaacgacgcggatccgctcatctttttgttcatattgccgtaaaatatctctcgttccgtccgttgaacaatcatccgcgataatcatttcccaatgcgggtggctttgatgtaaaacggactgaatcgtgtcttcgatatattcacttgcgttataagacggtgtaatgacagatacgaaaggtttccagtttgtcatggtcacatctccatcgcagatttttacaaggactctctaaaaaactcaggaatgacaatgaacataaaggcaactgcaatgccgattaaaacgcccagaaccgctttctttttcggcggcatgccttgaccagccgtttcattcatcggctctgaattgatgacgccggccgctttcaggttcagctgcgtatttttcaattcgtataaaaatcgttccttatccactttggcgtccgcgctgacggtttctccttcaagcgcagcaatactctgccgcactacttttgcccgtttttcaaacaagtcctgatcattcttcagaaaagttgttatgacggcttgaaacaccgattcggtttcctgtttgttttggccgctgtagctgaccgtgatcaatgaatctgattgtgtttcgacagtcagtttacttttcacggccgctctttcttcgtctgttttatcaggcagagcctgctttaaaaaggcatcgctcgtcaaaaggagcgggatttcttttgtattgttataaagcggatgatcataatttcccgcggcgatcgcggcttctgatgtaaaactgctgtttccgctgatttttgacggcaatacatatcccgccgcccctaacacaacgggcagcgcaatgatccaaatgatattctttttgatacgccgggttattcttgtcaacatatccttcatctcgcatctccctgtttttcatagtacgccgtgacggcaggctccttttgtaaacgcctcaatatattgaccgccgcgatcacgagcgagagaaatacccagtggaaaaataaatttgatacggagcttgggctgatgctgcttaccaaaaaaccggccatcgccgtgataagtccttctgtgatcagtcttgactgattttccgattttctttcatgacatttataaagtgtccaaaaaaggaacaaatagactgtcaggtaaccgagcatcgtaagcacgccgaagttcgccataatctcgacgagccagttgtgcacctcaactacgccgcccgtatcataaacgggctccgcttttaaatagtaagagacgtttccggcacccactccgaacccccaggaatcaatcacatagtgaaaggcgttctttaaaagattcgccctcgcgaggttggaaggaagcggctgctgtcccggcatcgcctgcggagctgaaaacagattcaagacggcattggtgatacggcccgcaaataaaaccgcaaacagcgcagcacccgctcccgcagcgtacagcgcgaattttttcaacagataaggcagcaggatgaagacgtatacagccgcccccgcgcatatgcccagcagactcgcgcgcgaaccggtcaaaatgattaaatacaaagcgcagatcgctaagagcaggctgacggccttcacatagccgtttttcatatttttcaccgccgccgcatacagaaagaaactgatgcacaaaaacgtcgcgaaatcattttgattaaagaaaacggacgtcggataatgctgtttgtactgcgggccgttataaagcgtggagcttggcagatggttgtgtgtaaaatggttgtaaaagccgatcgccatcacaaaaatggtcatcacaagccatatgccgtaaaaaaccatcagctgatcaaagcgctgaatgaacatgacaataagataaatcaaaaacatgcccattcccattaaagctaaatatttaatcccgtacgtcacggattttgcccacaataacgataggagaccgtatgtaaaccataaggcgaaaaacatcagaacctcttttacattcacccgattccatctgtcaatatgatgacggtttgtcaggatgccggcgatgtgtagggcgcccgctccgattaataacagccggtatataaataagctgaaaaatccgagatgaaccgcaaagaaggcctggtttaaaaatgtacacgcgatcagtatataaatgagccccataaacatctgaccgtttgttgtaaaggcggatagcaaagcaagtccggcaatgccgatcatggcggcaagcagcagcacggtgatttttccgaggccggcatccgccctgaccgcctccagcatgatgaatcctcctgtaatgacagcggcaagcagcacaagaacatgtgctgctgaacgtttgatactcacatggcaaacccctttccaaaaccggcagccgagccgggctgccgagagcctgaagacaaatctttttctatcttgccagttcttttatttgccgatcggcatgaaccgccggacgaccgacggaatgataagtgaatcctgaaaccctcatatactccaacggaaacatatttctgccgtcaatgatgaccggctgtttgagcagctgcttcactctctgaagatccatctccttgacttccggccaatctgttgtaatcaggcatgcgtccgcgtttttgatggcactgtacatctctgcgtgatattcaatgccgccttctcctaatatcgctgccgcttcgggaatcgcgatcggatcatacgctttcacgtgagcgccctgctctttaagacttgtgatgatatcaagagccggggcggagcggacgtcatttgtatgcggtttaaaggccagccccagtacggccacggttttcccttttaagggaccgatggcgcggttcaatttttccgtaatacggaccctttgcttctgattggtttcaatgacggcttccatcatttcaaacggatagccggcggcgtttgcgatatgcaataaagccgttgtatccttcggaaagcaggatccgccgaatccgatgccggcctgcagaaatttattcccgatccggctgtcaaggccgacgccttctgacacgtgagaaatgtccgccccgacacgttcgcaaatattggcgatatcgttaataaaagatattttggcggctaaaaaagcatttgcggcatacttaatcatttccgcgctttcaagattggtctttacgatcttcgtacggaacggcttatgaagctcttcaatgaccgaagcggcatgttcgcttgtggcgccgataaccgcccgctccatctgcatcgtatcccgcaccgccgaaccttcgcggaggaattcaggatttgacgcgacatcaaacggatattttccctttgacgcttcgctgacgatttggtaaacgagctttcccgtcccgaccggaacagtgcttttggtgacaatgattttgtatccgttcagctgttctccgattgtttgcgccgctgccttaatgcaggtcagatcggcttcacccgtctttgacatcggcgtaccgacggcgatatagacgatatcagcggctttcacagccggctcaatatcggccgtaaaggataaccgcccggcactgacatttttttcggctaattcctcaagccccggttcatatatcgggatgactccgttttgcaagcttctgattttcgcttcattgatgtcacagcaagtcacatgatggccgatttccgcaaaacaagttccagatacaagacctacataccctgttcctaatacagcgatttttttcacagcttcatccctctttcgaaaggttctcctcttgcccggcccggttcatgacggaccggtatttctctttcagcgttttcgcattgtggcttgcgtcaaaatacgtgcggacggtttgataaagttcctcggctgtttgcggcgtccaagcctctccttcgtcatattgcagaatggattctgccagcgtgtcaggcgaacccggcttgatcagcaaacctctatatttcccaaataaagaagccaatcctccgacatcggtacagatcaccggcaccttcagagcgagcgcctcaatgaccacagtcggcatgccttcgctgtaggacggcagcgccattatatccgaggccagcagatagtcctgtaccttgtcgttcggcacttgccccgtgacgatatgagcggcttcacgcaatgaagatgcggctggaccgtcaccgacaaagacagcttcatatctttcatccaatgactgaacggcttttgataagtcgaaaacacctttctctttgacaagcctgccgatgaacacgatcagttttttatccggaggaaggccgagccgttttctgacggcttctttcgtctcgttcctttttcggaaggcgtcaagcgtgatgccgatcggaagcacgctgcactccgcttcgatgagctttttcatttgttcccgcagactgccgctcacagcgtaaatatcggctgcttcccgcaccgcaaatgtaaacgcgcgatgagcgcttttgctgtaatgcggatagacattgacatcactgccatgcaaggtcagcacatacgggatgcctaaagcctttgacacaatggcggccgctccgcctgacggcatggcgaaatgcgcgtgaatcagatcgggcttcaggccatgatttttaatttcggaaagaaccgatgacgccattcttttatgcggctgcgcccatttcagctgcccgggaaccgcctgataaaacggccggtggacggacacgcctttccgccattcatgcgccggccttatatccttttgccgatacgtctttttcagcacccggaatggcgcggcgagtttcggccggggacaaatgacagtcatctccgcgccaagctttctcagttcttgggcctgcgtctcatgaaaaacgccttctcccggcttctcactgctcggatatacacttgtcatccacaataccttcatagcaaacgtccttttcttaatttacttttcatatgcggataagcttttcctaacaggaacaaataacacaatgctccgcaggatacggagatcgccagccgcagcttgacatcaaggctgatccgctccgtcccgaagctggctgtaaaggcgatgacacccattgccgccgtaagcagaaacggtttggccacggctttgaagtaagccgacagccgcagcttaatgacatatgccagcagccagcgcccgatcaggaaattcaggatgctgatgaaagcgtacgtccaggctaccgtcaagagatttccggacagcacggcggcgtacaaagatgcaccatacagcagcatcaccccggcgtcccaataaaatgccagatcggcccgcccttttgccagcagcacagatccgttcggattcatcagaacccttaaaatcccgacgatggcgagaacgtttaaaaccgggacagccgccagccatttttctccgaaaaccgaagccacgaatgcatccgatactgaaaccaaaccgagcaaaagcggaaaggatatcagcgcgagtattttggtcatattgagaaaaccttctctgatcacgctattttcatgcttgtttttcgcaaagacgggaaacgcgactctcgtaatgatcggattgatttttaataccggaagcgtgacaatctggtaggccagattgtaaatgccgagcgcctcggcgccgataaaactgccgatcagaatcatatcaatattcgccccgagccggttcacaagccgggaagacagctgaaaggctccgaaagaaaagaagcctttcattcccttcagatcaaaaacgaacgccggtctccatgtttttctgcaggacacccagtacagaataccttttgacgattgcagcagcacctgggaaatcacataggcgagaatcgggtccgtataaaaaaccgcagccgccaagtaaacgaaggacagcacatttgaaaagatttcaatcttgcttagcgtgttaaatgccagcgctttttgcagcatatattgatattgctgaccgatcggcgcgattaaaaacatgacggccagcacgcggattaaatagacaagctcctcccgccgataaaaatcggcaatgagcggactgctgaagaacagcagcgcaaacagcgcaagccccgttatgatattcagccagtacaaggaagacatctgtttatcagtcacatgatctttttgaatgagcgcggcgccaaaacccatatcaagcgcaatttgggcaaacaccactaccgttgtgatcatgccgacaaggccgaattcagccagtgacatgacccgcccgagcagggcgaattggacgatttgaatgaccgtaatacacgctgtcgaaatacttgtccatttggcgccgctcaaaatttgatttgtaatactaggcatcgttttccctacttttttgtctgctgaccagaatttttatcgcgccccgtcaccggtccagatcactttgcacgttttgagcataatcttcagttccaatgaaaaggtcaggttgcggatataatataagtcaaacatcagtttttccctcggtgtcatgtcatatcccccgttgacctgcgcccagccgcttaatcccggcttaacggccagccgctccgtaaaccccggaatctcagcctgaaactgttccgtaaacacgggacgctcgggacgcgggccgatcaggctcatttctccccgaaggacatttaccagctgcggcagctcatcaatacgggtccttctgataaaagcgccgacctttgtcacgcggggatcctttttcagcgcccagaccgcccccgatttttcagcatctattttcatagagcggagcttatacaaataaaacggcttcccgtctttgcctacccgctcctgcttgtaaaaagccgggccgggcgactccaaacgaatcagtatggagaacaggcccatcaccgggagcgccgccaaaagccccgcaagcgcaaacacaatgtccatgaatcgcttaaaagccaaataacgggccgttctttccgtaacggcagcggaagtcccctgccgcactgcatagttattatttacattcatgcttttctctgctcccactgacacacacctcacgatttgttgggatgtttgatgacctatgccgtgagtttagcagatggatgttaattggaagtaaagaaaacgttaatgtttattagaatgtttcgattattgtttttttattgtaaatctattcatatccatatttgagacaaagcataatgaaaaaataaaaaaacagaccggtatgaaccggtctgtttccatgaaaaaaattatctgaaataggaggaaacgccttgggtgatccccgccgcgagtctgtcctttttcgttgattgttttagaatattggcatcaatcgggcttgtgacaaaaccggtttctaacaagacactcggcattttagaatacttaatgacgtaaaatccggcagttttcacactgcggtcacgcgtgccgagagcagaaaccattctcggctgaatattttgggcaagcctcagactgtttgccgattggtaggttttatcataatacgtctccgtaccgtttgcactgctgttatcattcgcatttgcatggacgctgatgaaaatatcggcgttcgccttcgcccctttgttcactctctcctcaagcgaatcaaaggtgtcgccctttcttgacattacagtaagcgcgcccgcgccgtataattgattgttaagacgcgtagcgatatcaaggtttacatttttctcaagcaagccgtttccggttgcacctgaatcctgatagccgtgtcccggatcaataaagaccgttttgccgacaacgggatttttaagctgcgacgcggcattgttgcttaaagatgaagcacttcctatgacggtgaagctggtgatgtttttacttccgatatacgtccggacgtcttttgacagactgtctccattcgtcagcaggtgaactcttccctgtttggcgctcagcacgcctccgacgatggtatccgcctctttaaagccattggtaacaaacgtatagcctgtgcttaagcctgtcttttttgcaagattcacagacaggttatagcggtttttgccgctgattctcgaagggttcggcagcttattataaagtgagctgctgatgctgcttgtcccgccgatgacaatcgtgtttttaatccctaagcttttgatcgcattggacgcagaaccatttaacgttgaatcattagtgaataaaatcggatattttttagcggacgcataagaaatcgcagccattccatccgcatcaacaaacccgttgaccacaagggctgtagaagatcttgtcatttcacccgccacttttgcggctgtggcatatctcgtgctccctgataaccgtttgacactgatgcctaatttagcaatttgatttgcggtatttttcgaaacggcaggtgcgccgcctacgataaccacatttttcgtttttaaatcaattaatcccttttttgtgccggcagacagctgatctttatttgtaaacagcagcggcgcatttttttgatatgcaagcggcgcagcggcaattgcatcggcatatgaagttccgccggtgataattaccgttttcgcttcaccccatgattgttttgccgccagtacagccgtatcataccgggtgcttccgccgatccttttaaccgtgttgtcagccaaagcggaagggacaaatagaatgaccccgagaataaagacggggagacattttatgatgaatttcaatccgatctcctccacagaagtttagtagtttgtaagtgctgtattaggataatagaacgcaagaatagaagtatacggctctccggcctccgctctttcttttgctccgtattgactcattcctacgccgtgaccgtatccctttcctgatatcgtgatttgcgaagaattaccggacgcactggcgtatgtgcttttaaaagatgaagctccgatcatcgtcctgagttcagacgctttcacctcaacagatgcagtcttgttcatgacatagcccttcgacttgtcattcacatggtacgtgaccttcaccgcggcgtcttccgcgcgctggccttttgtttttccggtgagcgagagatcagagatacttgcaatttttatggaacttgcattggtttctttatttttcatcagccaattttttattccgttgagctgcgcagcatttgcttcgtttgttttagaccaccaggatgcgggacttttcatatccagacccgctggcagctgctgcttctgcaatgttaaagaccagctgatttccggatcttttgtgtcctttttggctactaaatacggcactttcgatccccacacttcatcgccggcttccatgtaaccgccattgcttgatgagtaagtggcatctatcaatctgccggaataagtgagcactttcccttttgttccgttaacggctgcggtggcgtttggataccagctgtatcccccgtaaacctgaaaggccgttgtatccgcgactgtttgtcccatcttgccgatagagtaggtgcgggcggcaacagcctgggctttcagcgcttctgtcggccagcttcccggcatttcattcggcaggacacctttcagataatcctcaaaaggaatgttttcattaacaggtcttacatatttgccggattcagcagtgaaactcatattccccagatatggcttcccgtcaatgctgattgtgtttgctgttgaatatttttcaggaaccgccttgaaagacgtttttccgctgttaatgcctgcaacgcctaatttgccgccggacgtttcaatacggtacgtctttccgtttacgagataaaactcttttgcgtaagcagccttaactgaatcggcaattgaattcgcgctgcctattaatgtataagaataggtgcctttcgttttaaaaaggccggcctcgtcggcgggtgtttcgctttttttgatgtatacaagcggcatgtgatttgcggcggcaatatttgatccgactacgatgtccgctaatttagtcccgttggcagccaccgttttgcttgcatccatgccaagcgaagtgactgcgtttgctgatatttgatatctgtttgatccggtaattcgtttggtgaccgaggccttctttttaatttgattctccacatctttgctgacgcttgaagtgcctcccatgatgatcacttttttaggcagattgtagctcggaagggagtcttttttcgtcagaagaatcggatagccgttttgcgcggcatatggcgcgattgccagcgcatccgtatatacatcccccgttactacgaccgcctggtcatagctgcccatttcggccgcaatatttttggacagatcatatctgttttttccgctgatccgtttcgtacggccgtatttcttcaatgtcttttccgcggctgacgaaatactgttcgtcccgccgatgattaaaatattatccggattgaatttcttgatttgcgcttctgtgctgctgctcagttttttcgcttcagtcagcagaacaggcgctttcagtttattcgctaaaggaatgacggaaagcgtgtccgcaaaataagcgtccgtattcacgacgactacgttggacgggtttttccaatacttagatgtcgcggcgttagccgtatcatatttggacgcgcctcccaatctgacaacggaggacacatcgcttcccgtcagtttataagttcctgaaggttcgatattcagagtcgatttattaccaatataattcgtcagttttactgagatatcagaactggccgcaaaagtgctttccggtaataaagccaggctgaatatcacagaaaaacagacagcccatattgttttcttcaatttttatcccgccttttgctgatcatggtgtattattttgctttctcgatttccttgatctctttttggcctttatcatttgtgaaataagtaatgctgactttgtcattttcgctgaatttattcagaacatcagagaagtcatcagaaaattcaaagctgacgggctgatcatccacttttacttcaattgtgtgcgtatccgccataccgacataatatgccgtttctttttgagcctggttctccgaagaaccgcttcccttctttgattgttccgccgttccgcacgctgccaatacaacagaaaaaagcagtattaagaacgaagctgcaatagtttttttcatttttttcacctcatctttatgtatcgtcttatactaacttttttttaaggtaattttaaggtctttttgtaaccttttttttaagaatttcgtctattacatggttataagtaaaaatatgactgggtttataaagattagtaaattgcatcatgaaagttaatagaaaaggtgatgacaaatgagagctgaacgaaaaagaaagaagaaaaaggttcttctgacaatcgtaacaatcatcgggctgttagttttatcatcaggaggctacgtctactacttgtggcacaaagcggcttcaacggtggcaagcattcaggaagacttaaaaaaatcggacaaacgtgacacggatatagatctcggaaagaaggatccgatttctgttttaatcatgggagtcgatgagcggaaaaatgacaaagggcgcgcggacacgatgatttatatgaccgtcaatcctaaaacgaatacaacggaaatggtcagcatcccgcgcgatacgtatacgaaaatctccggcaaaggtacgatggataaaatcaaccactcctatgccttcggcggaacccaaatggccgcggataccgtcgaggacctgctcgacgtgccggtagattattttgtgaaagtaaacatggagagcttcaaagataccgtggatacactcggcgggattacggtgaacagcacgttcgccttcaactacgacgggcattctttcggaacggggaacatcagcctgaacggcgaagaagcacttgcctacacccgcatgagaaaagaagacccccggggggatttcggcagacagcagcggcagcgccaagtgattgaagggattatttctaagggggcaaacatctcgtctgtcacgaaattcggagatatgtttaaggtcattgaaaacaatatgaaaacaaacatgtcattcgatgatatgtggacggttatgactgactataaaaatgcccgcagcaaagtcactcagcatgaactgaagggaacgggaacgagaatcaacaatatctattattacaaattagatgaagcaagcctcgcttcagtcaaaaaagaattaaaagaaagcctgaaataataaaaaactctgcatatgatgcagagttttttttattctgtaaaaggctgcggacgggtttttctatagccgtaccgataaagcagttcttccgcaatccgttttgaggccgatccgtcaccataagggtttgacgcctttgacatccgttcatactcggcctgatcggttaagagctgttttgtcagctgatacaccgtttcttcatctgtacccgccagcttcaatgtcccggctttcactccttcggggcgctcggttgtgtcccgaagcaccaagaccggctttccgagagaaggcgcttcctcctgaaccccgcctgagtcggtcaaaatgaaatttgctttcgcagcgaagttatggaaatccacgacctccagaggttctattaaatgcaccctgtccgaatcagcaaaatgggcttctgcggcctcacgaactgcgggattcaaatgaacgggataaacgacttgtacgtcctcaaactcttcaacgattcttctgacggccttaaacatctgtttcatcggcctgcctaaattttcacgtctgtgcgctgtcaaaagaatcatcctgcttccttccagcttgtcaaaaatcggatgagaatagtcttcccgcactgtcgtttgaagcgcgtctatcgccgtatttcccgtgataaatatagaatccggctttttattttcagcaagcagattctgttctgcctggcttgtcggcgcaaaattcacatcagcgatcacgcccgtcatctgccggttgatttcttcagggaaaggagagtatttattttgcgtacgcagaccggcttccacatggccgacggcgatttgatgataaaaggcggcaaggcttccggcgaacgttgtcgtcgtatctccgtggaccaaaacgatatctggttttacttcttgaaacagcttgtccagtttcagcaaagcatgagatgtaatttctgaaagcgtttgacgctctttcataatattcaaatcaaaatcaggcgtgatgctgaatgcttcaagcacttgatccagcatctgtctgtgctgtgcggttacagtcaccagcgaatcaatttcctgatatttttcaagctctaatacgagcggagccattttaattgcttcaggtcttgtaccgaatacggtcattacttttagttttttcaacggtttgtctgcacctcgttttatatgtcggatatcccttcatgttaacatatttatgccgtttcttagatattgtaaagcttaatggcaaacaaagcaaaaaccgttacaagactctttgaaagcggattaaaaggtgtgaattttaatcaattgtggtaaagtggaaaaagactaggttatagttctgaaaaaaaagattttgcagaaacaaggatggtgttattcagtgaagaaagtacgcaaagccattattccggcagcaggtttaggcactcgttttttgccggccacaaaagcaatgcctaaagaaatgcttccaatcgttgataagccgacaattcagtatatttttttttttcaagcagaagacggcatacgagatattattatcgtaaccggaaaaggaaaaagagcaatagaagaccatttcgacaatgcccctgaactggaacgcaatttagaagaaaaagggaaaatcgaactgcttcaaaaagtgaaaaaatcgtcaaatattgcggatatccactatattcgccaaaaagagccaaaaggactcggtcatgccgtttggtgcgcacgcaacttcatcggcgatgaacctttcgccgttcttctcggcgatgatattgtccaggctgaaaaaccgggacttcgtcagctgatggatgaatacgaaaaaacattgtcttccatcatcggtgttcagcaagttcctgaaagcgacacacaccgctacggaattatcgatccgttaacaaatgaaggccgccgttaccaggtcaaaaattttgtagagaagcctgaaccgggcacagctccttccaacttggctattttaggaagatacgttttcactcctgaaattttcatgtaccttgaacagcaggaagtcggtgcaggaggagaaattcaattaacggacgccatccaaaagctcaatgacattcagcgtgtcttcgcttatgatttcgaaggaaaacgttacgatgtcggtgaaaaactcggatttatcgagacgacgcttgaatttgccttacaggatcaggatatccgccataaattaattccgttcatgaaggatcttcttgaaaaagaagaagctgacgaatagaaaaagctgccgaatccggcagctttttttatgtgatctttactttttagacgttaccgtcagtgtcttatcagcattgttcacagaaaaagtatattcctggtttttaagcatgagcaaattctgattgattttgctgccgcctttttcacttaaagctgagatgtctgcaggacgcgataaatgaaaaaccacttcggagactgtatcattgtcaatcactacatccgtttttgcatcggatgcttttaatacgttccgtccgtcagccgtttgtcccgcagctggatttttcaatttacgctgcacatcgtcccggcttttattgagatatgagagaaactcttctgctgtttggcttgataaactgccgctgaaatcattcagctgaacatccgtcttttttaaagcgttcaccttatacagatcagtctttttcataaagtactctttatcgtttaatttcactttagccgcctggttattctcggcttctatctgcaccttcgtaccgaaacttacacttgcggaggcttttccttttatatctttttcagtgtaaaggtccgccttttcagcttttaccaaagcaggtttattcacagactcataaaggccggcatcgctctgtttgacgtcaccgaaagatgtgatcgcacgcagaggcttgtctgaaaacatcgaagcgcctgcgccgacagccagcaatgcaagcagcgtaatctgtatcgtattggcaatgaatttaggcttcgctttcttttgctgcgcctgagtgattttctgttcctcggctgcccgcgttctgccttcaatctgctcgttttgatatttctttttttctttctttgaaagcttgttgaaccaatccacaaaagctttatattcttttacaacggctttcgtttcgtcgaacatacgcatttcgccgtaatgcatccaagccacccggtcacacattttctcaatctgtccgatggaatgactgacgaaaaagatcgttttgccgcgttctttaaattccgtaatgcggtccacacatttctgatagaaagtctggtcccctactgagagcgcctcatcaataataaggatgtcagggtccatgtgcgccgatatggcaaaaccgagacgggatttcataccgcttgaatagcttttaacaggctgatctataaagtcgccgatatccgcgaattcaacgattttttcataaagctcgtctatctgccgattgttgagacccatcatcaagcactttaaacggatgttgtccttgccgcttaattgattgtttaatccggcagaaatcgcgattaaagacggctgcccgttcatatcaatctcaccgcttgtcggcggaatgatctttgcaagcagattggacatcgttgattttcccgagccgttgatacctacgaatccgatcgtttccccttcatagacgtcaaaagaaacatttcggacagcgaaaaaacctttttgatttctgtttgggaaaaacaatcctttaattttgtcagactgttttttatatagaaaatactgttttgaaacatttctgaacgaaacttttagtttcatcgtataatctccttactatattaaagaaagtcaacaaacttatctctgaatttcatatgaagaagtgaaccgactgttaacagcagcagtgtgacgaaccagaaatacagcgtgtatttcacatcgtggaaaaaccactgcccttccataaagctgtctctgaagccctcgataatatagaaaagagggtttaacttcaagatggtcaaaacttcaggtctgtttccaaatttctccgcaatgtcccagaaaatcggcagaagaaaaaagagaagccttgtgacggcttgaagcaaaaactgatagtccctgattaatacgctgatggttgaattaaacaggccgaaagcaaacataaaactgatcatgcaaaacaagtaataaatatattgcagccagtgaagcgtcggaaacagtccgttgctcagcagcacaataatataaatcgccatcatcacaaagtaactgaataaattcgatgctatcactacagaaggcagtgaactgatcggaaagttcattttcgacactaaatttatccgtttaaaaacgctgttagatgcatccagtatcgtcggactgataaagaaccaaggaattaagccggccagcatccagacgatgaacggtacgctgtctccatttccaagcaccatatcatgtccgccgcgaatcccgagaccaaatacgaaccagtaagccagcatttgaatcatagggttgagaaactgccacaatatacccaaatagttcacttgatactttgatttcgtttcgtacactgcaagccgcataatcagcggaaatgagttgaattgctctttcagaatttttaccaatgcattcattctaatcttccttagtcgtaagttttaggtaatagctttgacttacaaaagcaccgctcataattgtaacagattacgatgtatttttcacttcataacaagcctgagtcccatgagcgcaacatgccgtcacttaagcaaaaaagcataattaacatggttaaattatgcttttttgcacttatttacttgttcccgaaaatcacttttacggctttttcagacgattctccggtttctaaataacagaacttctcgtaaaaaggcccgaacgaatccggaagcttataatcatctgattccgtttcattgacccatttgataacgtcacctgtttctttgacaagcgggccgggcgcttctttttcaaagtcaaagtaaaaccctctgagtttatcccggtacgtttcgatatcaggcacataaaacagcatcggtcttttcagattcgcatagtcaaaaaagacagaggaatagtccgttatgagtaaatcagagaccatatacagctcacggatatcttcgtagctggagaaatcatacgcaaatccttcatacggtccgagatcaaagttttccgccacaagataatgcatccgtaaaataatgacataacggtcgccgatcgcttctctcaattggtgaaggtctaaatcaaggtcaaacttgtattttccctttttataaaattggtcatcccgccatgtcggtgcgtagataatcacttttttatcttgcggaagattcattttttctttcagcgctttaatgacagaagggctgttatccgtctgaaggaagtcattccgcggatatcccgattcaatcatggttttattaaactgaaacgcccgggcgaatatttcggttgaatatgcgttcggtgaaatcaggtaatcccactttgaagcctctgtcgtaaagttgcgcttgtatttttcagtgtttgttccgggcatatgcacttcatccatatctacggcaaggcgctttaaaggcgtgccgtgccatgtctggacatatgtcgtatgctcaggtttcggaatccacagcggcatacggctgttgacaacccagtactcggctcttgccatggcaaacagccatttgaacgtgaagcgttcgatataaggaatccctttatctttaaatgtctgtgagtaagcggggtttacactccagcagagacggtattccggcatctctttgctcatgtattcataaatcgcccgcgggttgcagctgtactgttttccggcaaagctttcaaacatgacaagtttctgtttgacaggcagttttcctgcaaatctgaatcctgctttgtaagtgttctgtattcttttctcaatgaactttttcagcttattctttctcttgcgtacaaaggaagcgccccgtttcagctttcctttcacaaaatactccacgcgggtgctgaagctgtaatcgttcattctcaggtggagatttttcgttttctttttcgtgaaaacgtgaaatctggcaggccctttttccgttttcagaaccgtgaattggttagggtttacatgttcagatttcagaacctttaacggtttgctgttggtgataatctcttcacctgtcccggcatcttcaaaaatgaattgaatatggaattgaaagatgagctgctgattcaattctttataaacggcattcaaatcaatttttgtatcaaagcctatcgtgtcaagcatcgttgtgtcctgaacatattcatcaaggtcgtgtctcggcacgtcgtgaagcggatacttcagaatgagaggctcctcttcttttccttttttcattttcagaatcaggtttttttcttttatctttaaggtttctgccgcattcagccggaatgcaaaacctttcagatgtaagctgccgtcagattcgagctccatttcatcaatccgcgtgacgaactttttctgcagcagctttaaggagaaattccctttcttcgtcgtgtaagggaaaaagtacatatgatgagcctcatctttataagaagacagttcaataggttcaaggctggattttaaccgttttttactgatatcactgtcatcattgataaaggagacatagaaatccagacatcctttgccgtccgtatggtcagaaagcagatccgtgctcatgacagcatggtactctccgccctctccggccaaccgtttcagagggacggaaagttccgcttttgttttacgatttataatctgaagagaaggctcttcccctgcagtgacattttcacaggatatcgtaatgctgaatgtctcttcctttatgttaagatgttttaacttgtatctgacaggattttctatacccataaaataagtctactcctctgtttcaattaaacatatccaatcacaatcatcattttgttactttcagtgaaaggttctccttcaccgtccggtagaattgatattgcagtccgttcgcttctgccgtcaccttttcaccgtcttctctgtttaacatgacacgttcataatcgttataaatgacatacataatataaccgccaagtccgactttttcaatgtcacttaacgggatttcaaggacgtaccgcccgtctcccagtgactgaaccggaaactggtggtgtactttcatgttatctctgtgctgaaactgaatatattgggcattatttctgtcctgtccgaacaagcggaacgtaacggtgaatttatgatcggcgaacaccgcgctttccgtttctccgtgcatgcgaagttcgaccagtttattttcttcatccgtcagcgggctttctaaataagccagtccgtctttcgtcacgatgtttttatcgggctcttttttggaccagcggaacagcttttcgacctcatcataccgtttttgagtcagcagacggtaggctgttttatgaatcggatgaaaaaatgtctcggaaatatcgtatttcgtcttctttaacacattcagaatttcattgaatttattgtagtaggcttctttgttttcgcttttcaggaagtgcatccgatcgaaaagccgcgtaatggaatcgaattcaatcaggcggttcatcgccatcttctctttttcagtatctaattttttgttcagaatatacttcattacggctatgttcgtgtcggttttttccattatattggtctgctttgtcagcgactcattattgtccattctgttcagataatagaccggttcggttgacgttgaaatatctccgcacgccaaaagaacatccataaaaaattgcttatcttcagcaaatttcatttccggatatctgatatcgttatcttttagaaattgtaagttcatcattcttgcccgcgggcccagatgatagaaaatatgccggattgaaaaaggcgataccttcgctctgttcagcgaagactcatgtttcccgatcgttttttgaccgttcacctgcatttcgatcgtttttccgaccgcataatttacatgatctctttcaagcatgtcaaataagattttaaccccgttcggcgcaaaccaatcatccgcatccaaaaatgtaatgtacttcgcatttgccagctcaattcccaagtttctcggataagccggagttcccgtgttgtctttcaaaaagacgactgtaatattttcatacaattcggcgtactcagtcaggatgtttctggaatcatcggtagagcaatcatctaccagaattaaagaaatatgctgaaagccgatgttttgaaggatcacagaatcaactgttttccttacatattcttctgcattataaacaggaacgactaccgctaccttcttctcttccgccaatgcttctttgtttaaaatggtatattcgcgttcttctatggacggcttggactcttttttattcaacttaaaaaagttactaagattcatctttaaattctcctcttattgtctagctttttttcaaaagcgcataacaaatatagcgaaaataaccttatattacaagaagtactccctatccggagggagtacttctttatcatctgtatatccgaatgtttcaattacaccccggcaatttcttttttaatctgtgtggtggaaatgccttcggttctagggagatagatgacttcgcattgatctttaaggaaatcgaatttgccttcccaatcgtctcccattacgaacacgtcgatgttgtgatccgctacgtcacgtactttttgatcccagctgttttccggaatgacttcgtcgacataacggatcgtttccagaatcagctttctgtgttcatagctgtggtaggcctttttttgtttttgcaggttgaactcgtctgttgagatggcaacaactaggtaatctccaagctgctttgcgcgctcaagcagtttaatatgaccccaatgcagtaaatcaaacgttccgtaagtaatgaccttcttcatgaaacaaaagctcctttctatcatcatacgtataacaagcaactgccctgaaatgctgcgcagctgtatccttaatcactaaagtgccaatttcgtactcatggaacctcattatatcacatagccctgaaaaggttaagctaatgtaaaacgaagttaaattccacttattaacaaatgttattgcaataggagtttagcagggtttttgcgcggttgattaaagaaattgttatcttatttatatttttgtaaaactattgttaagtttatctgaaggtattatgttaaaataaagcttagcttaagtcacgaaaaaatgaaagaaaatcccgtacaaaaaggaggacggcagatgcagactgaaatggtgcacaacctttcttatgttaatggaaatttacaggagtttatttcatatttagacacttattatatcgcacaaaagcaaggagccgtcattgcgacggtcaaccctgagatcggatacgctgcggcgaaagacaaaggttatcatcaagtcatttcttccgcggatttcgtcctgccggatggtatcggcgtcgtgttaatgtcacgtttgacgcagcacccgctgaaatcaagaattgcgggattcgatgtgtttctgtcgctgctcggtctcgcaaaccggcagtctaaaaaaatatttttatacggagctaagcaagacgtgcttgacgccgttttgaaccggatcggcaaagagtatccgaatattgaggttgtcggagccagcaacggttatgaagcggataaacgcttcgtcgccaaacagatttcccgggcgaaacccgatctcgtgtttgtcgccttaggatatccccatcaggaacaatttatttatgaatacaaacatcttttccctcaggctgtatcgatcggtttgggcggaagctttgatgtgttcagcggaacggtgaaacgcgcccctgaatggatgatcaaaacgaatctggaatggctgtacagactggtgacgaatccgtggagatggaaaaggatgctgaacattccgaagtatgcttttaccgttttgagaaataataaatcaaataaaagcctgtattccgagcaggcagaagatcaaacgaaacagctttaaacaaataaaacagcaaaagagattggtaatctatgaacttgcgatctttattcgccgctttttattctatatatctgtctgttctgggcgttttgttcaagcctgtaaagcccaagaaccatctgaccctgctggtatctttcgaagagaatgcacaggctctcatccgttcttacaaagcgcacgctgaatcgctttcttatgaagtgacggttttgtatacgagacacgccgtcagtctgaaaaaagagctggaaggactcggctctttttatctgaacgaaaaacatccgctgcatcttttgaaggcggttttgatcctttttaagagcaaagcggtgataacagataactatttccttatgacaagcgtcttaaaccgccggccgcaaacgacatgtattcaagtgtggcatgcgaacggctctttgaaaaagttcggccttgaggatgtgacgaatcaaaaccgtccggcatcagatatcagccgttttaaaaaagtgtaccgctcgtttgactttgtcaccgtcggttcagacgcgatggctgacgtttttaaaaagtcgttcggcatacgggacggccagctgttaaaaacgggtgtccccctgactgacgtctattatgaagaacacaagcccgaaccgaagcacaaatggccgaaaaaaatcatcctgtacgcaccgacattcagggattatgatatgcagtcctttcggctgccattcaccgaagaacagctcacaaacgcgttaaacggagagtatatgctgcttgtaaagcttcaccctgccgttttgcatcatatttcggcttcgtttgaaagcgaattgatcaagaacgtgtctgacatgcgtcttcatgatctcttgaaagcggctgatattttaattacggattactcttccgtgccttttgaattcgcgctcttaaataaaccgattttctttttcacgtatgatctggaggaatatgatcgacaacgcggtttaatcgataattatacttccgtcattcccggaaaggcttgtcatgacagcgaagctcttttggaggaaatgacgaaaaagccatttgatgcagaagaaatgaagcggttctcggacaaatggaatatgtattcagatgggaattcgagtgaagcgttattgaaatttgcggaaacaaaaatgaaaaattgtgctgaagcacctgcctgaatctgaggcgggtgttttttgcatgaagaaagggctgaagcatacacttcagccctttttttatactttcatatacacgggaacatcatagtaaagcgtataatcatccagcagtgagtataagctgtacatgcggtttacctgcttatacgcccagccgatgtctgtcgcatactgatgagccgcggctggagaccatctcattttatacagcgtatcctgctcgtatgaaggattgtgaatataagacgcaccgataaattgggctccgccgataatcgcggcttccggagtaaaccagccttgcttatacgcgtattgtgcgccgtagtaattcgggttgctgtcataagccccgatgccgtacatgttgtaaacctttttaccattatacataatgccgttcgcaagctctgacgtgccattgcccgtttcaagcaaagcatgcgaaatcaaatacacttcattgatgctgtatttgccggcggctgtaataaaggcctggcctttccctgtcagtattcctttattgaccagcactttttgattcagttccgatgcgttcagtccggctgtctgagagagcttcagaaattgaaagtaatacttgctgtcttgtgcgaagtgagccggattgacgtactgcccgacttcgtcactgctggcgtttctccagcccatgctgagtttggcccagccgtttgtctggcctgtgatgctgactttatcgccttttttcaactgcccgataatattgccggagctgacttccggggttgaccggacgttcaggacgtcggctgtgaccgttccggaagccgtattgatgtacgtaagcgatgcataagccgcggcatcagtctgcgggctgaccgtcatttgttttttgaccatatctgccagcgagatgttgtaattggtgttcatgatttgcggtccgttttttattttcagaatagccatcgtccatccgtacagctttttcagcttttgggaggcggcgtccgctgactgcgctcccgtgaattgattgcgaatgcggagttcataaaccggatggctttcactcgtatagccggcctgtaattgtttggcgctgaaaaagctcatgcttttatttaaaacggttttactgctgaatttttcggttttgatgacgtattgtgcagagccggttttccccgtctccttcacagtgccggccgctttgttttgcttgaaaaaagcagtcacgcggtcaatgtcttccttcttaagcagcggtgccgtttcaattctgaattgtgtatacgccgcttcacctgttttctgtgcggaggcggatacttttttccctttgaaaaaatccagcgattgattgatctttgccgtatcaagcagtgattcggttgtgacttggtacgttgtgtccgtctgcttggatatcgtttttgaaatggcagtcagtttatatcccgccagcagattcaatcctttttttatcttcgactggtctgccgtctgctgagaaagcagctgatattcgttttctgctgtttttcccgccgctgttcttgccgtctttacatgctgctggcggaaaaacgcctccgtttgttctgcctttgcagcggtaagctgccctgccgtgaaccggtaaacggacactgatgctgtctttttgacaggcgatgcgtcgcaatgccattttttctttttaaagaaagcttgcacgctttgcagctgtttagccgtcagtccgctcatcgcgaccgtgtaattattcttcttgccggctttttgatagcttccgctgacacccgtattcttcttgatttgggtgatagcattttgtacggcgcttactccgttaaaatatcctgactgcacgttatacacggttgctgttttgctttgggcatacttttgaacgttccctttgacgcctgttttctgctgcagctgtttcgctaaacctgccgcatcagttgcatttgaaatgccagaggctgtcacggtgatattcggactggcctttgccgtgactttcagcgacgactgcaatcctgtttccttttgaaaatcagtttgaatttgagcggctttttgatcgccggagattgttcccgattggatctgaaaccgggctgtttcccgtttgatctgacggtatgacgctttcacgcccgtctgcttcgtcaacgcttgcgagagtgcttttgcatccgcatcggccgccatctcagaagtcacgacctgcttatacggctgttttgtccccgccggcttgacggcgccggtcacgcccgtttttttcgtcagtccggcaagaagatttttcgtctgccgctcgtctgatagaacgcctgatgtgacggtcacgtacggctgtttgcttccgcttgcgctgtaagtgcccgccacgcccgtctgcttcgtaaaatctttcagcacggttttcgcatccgtttcatcgtgtaagcctgaagctgagatttgataagtgagcggcgcatttccggctttctttgcgtcagcctgccaccccgtatcctttttcaatttcgctgccgcttgaagcgcctcgttctcagaagcaaattgctgcttcgtttccagctcgtaaacggagtagtcgctgtatgcggcctcggcgtgctgtgtaacggtgctaaagacaaggaaaacggcggacaataacataggtgcaacgaatctctttttcattccttctcctctttctgattcaattggtttctatcaaactagtttatttatcggcccgctttcttcatttttacagagagaaatcatccaattatccaaataaaaaaaacttaatcccagagctgggattaagtttggttttatatatgagaaacgatgatcgtgcaatctccgtttatcgtaaagtcaggcatctgatccggcagtatgaaatgcgcgcctttttcaagcttggcggacttgccttcaaagatgatggagccgcttccttctgtgacgctgcacagcataaacggagcgtcctgggtcatttccgccgtcccgctgatatcccatttgtatacagaaaaatattctccctgcacaaaggttttaatggtgatgccttttctcgtttcagttgattcatccaaaaatccgtccacatgaggaacggtggcggcgttgacggcatcgcggatatgcagctcacgcgcaccgccgttttgatctgtacgcccgtaatcatatatccggtaggcggcgtctgaattctgctgtatttccagcacgagcgccccggcgcaaatggcatggatggttccgctcggcacataataaaaatcgccaggtttgatcttcacgcggcgcagcaggccttcccagtcaccgctgttaatcatggtgacaagttccgctttcgaacgggccgtatgaccgtatatgatttccgcattttctttacagtcaataatgtaccagcactcagatttccccgtttcgccctgtccatgctcctcggcgtcataatcgtcaggatggactttaacggacagaggatgtttggcgtccagtattttcgtcagcagcggaaaccggtccccttccgttccgccgaataactctctatgctgatcccacaggtccatcaaggttttcccttgatacggaccgcttttgaccgtgctcattccgtgcggatgggctgatatcgcccagcattcgccggttgtttctgaaggtatgtcatatccgaatcgttcgcgtaataacgtgccgccccatattttttctttacatacaggctgtagaaaaatcggctcttgcgtcatgttcgttcccctccccttaaaaagcggctcatatcccattccccctgtgtcttttttaaaacacggagggagccgcggttaaaaacaatatgtataaaatggctgacctgctcattataccattcggatggggcggaatgctcagtcatttcctattccagaataaaatgccttgtttgtcgcaaattaaaataactgatggaaaggggggaacattatgacgatacatgcggagctcggcaaaaaccttgaagcgctgaaaaaacggatcggccaaagcgatgacatgatgttttattcgtttacgtacggaaacggcaaatgtgacgcctgccttatatatatagacggactgaccgacaatcaattgcttgcggaatatattatttcgcccgtgcaggcggccgccctgcatcaagaggaaccggctgaaataccgccgtcatccatctctttcggctatcgtcacacccggctttcttcacttaaggacgcggaggcagacattttttccggcaaatcggttttgctggcggagggatgggaggaagccctttcgtttgaaacggaaacatttaaaatgcgtgatattgaagaaccggcttcagaagtgcttgaacgggggcctaggataggttttgtcgaaaagctccgaacgaacacggcgcttttgcgcgagcagtccggtgatcccaacctccagatcaaagagatcacactcggcgaacggacaaaaaagcggatcgccgttgcctacattcgggatattgcgcctgatgatgttgtaaaagaagtgatgaaaagactggattcgatcaccattgatgacattccggaatcaggaacgatcgagcagcttattgaagataacacgtattccattttcccgaccgtcttgacgaccgaacggcccgaccgggttatgggcgctcttttggaaggaagggtctccattcttgtagacggaacgccttttacccttttggtgccggctaccattgatgaatttatccactcacctgacgattataatcagcggtgggttccggttaactttctcaggctgcttcggtatacatgcattttaatcacgatttatttacccggcctttacatatcgctcgttacgtttcacacggggcttttgccgacgagaatggcggtgacgattgccggaagcagattgaatgttccgtttcccccttttgttgaagcgtttattatgatttttacgattgagatgatcagagaagccggactcaggctgccgaagccgatcggacagacgatcggcctgatcgggggcgtggtgatcgggcaggccgccgttcaggcgaacatcgtcagcgcgatgatggtcattatcgtatccgttacggcattggcttcttttacggcgccctcctatgcgttcaattttccgctgagactcatccgtattttttcgatgattttgtcggcgatattaggtttatacggactgatcatgtgttatctgcttgtcgtcggccatctgatgcgcctgaaaagcttcggccaggactatcttattccgatcatggcgcagccgggacaggacttaaaagatacgatcgtcagactgccgacgcctcttttgaaaaaacggccgaccagaaaagagacgaaagataaaatcaagcaaaggtgatcaccatgaaaaaaccggaagacaagctgtcgtttatgcagacacttctcatggtaagcggaacaatgatcggagcgggcgtgttaacactgccgcgctccgccgcagcagcggacagtccgagcggatggatcattattcttgtgcagagtctcgtgtttatcggcatcgtcctgctctttatgccatttttgcagaaaaacagcggggaaaccatttatgagctgaatcaaagcattatgggacgcgccatcggttctcttctgaatttattcatcagctgttattttgtcgtcaccgtctgttttcaagcccgttttctcggtgaggtcatcaattactttttactgaaaaatacgccgatgggtgtcgtcatattcatctttctggcggtcggcatctaccatgtgaccggcggggtgtatcccatttcaaaactctatgcttatctctttccgattgcgatcgtcattctgattacgctgctcatattcagcctgagactgtttaaactggatttcatccgcccggtcatggaaggaggctacaaaagcttttttgagctgtttccgcgtacccttctgtatttttcaggacttgaggtgattctttatctggtgccgtttatgaaaaatccgaagcaggcgaaaaaggctgccgtcttcggcatcgcatgcgcaggcttattttacagctttacgctgcttgtcgtaatcggctgtatgtcgatcgctgaagccaaaacggtgacatatccgaccatttccctgattcacgccttggaaatccgcggtattttcatcgaaaggtttgatatctttcttttaattacgtggacttgccagcagttcacctgtatgctcggttcttttaaaggagcgcatctcggattaaacaccattttcagactgaaaaataaaaacaatgcctggctgctggggggcttattggcagtgacattcggcctttcaatgtaccccgatgatatcaacagtgtgtttgcattcgcgaatattctcggatatgcgttttttgccgtcattatgattccttttctcatctggtttgtcagctggatgaaaaaaatagccgggaggaaacagacgtcatgacacatttcgtaaaatgggcggcggcgcttttcatactgatgacgctttcagggtgctgggatgcgaaggaagtcgaaaagctatctttcgcccgggggctggcgatagacgagacgagtgaccgccgatataaattaacctatcaaaacctgctgccccaaagtgaaaacagccaggcttccggccggcccgtgtttgtcaatgtgacgtcgcggggggataccattcttgaagccgtcagtgaagtcgctttaaaagatccgcccgtttacagcgatcatttaaaagtgctgatattcagcgacaaattgctggccgaccaaaatatactgcagatgatgaaccattttatccgtgatgatgaattaaggcggagcagctatctcttcgcggcaagaggcaaagcgtccgatattctgacagagccgacgccgaatcagcagcagcccatgcccgcggaaaagctgatcgaccttacgaacaacggcggctacaacgggaagattttaaaaccgctccgaatcgggagagcttcgatttactgccataataaactcagttttctcattcaggccgtcagcaatcaaaaaggaaaaacggtgtatgacggagcggccattatcaaaaacggaaaacaaaacagattggcaggctttctgtcatcatacgaagtacaaagcctaaattggctgacggggacgatacagggcggcgtgctgcccgctttggataaaggagggcacccgattaccttcgagatcaaaaaatcaacatcctccatcacccccctgctgaaaaacgggaagctgtcatttcacgtagcggtgaaaacaaaaggacttttgtcagaggatcaatatgccggagaagattcattcgatcagcactatttaaacgggctggaaaagattttcgaaaaaaaactgaaaagcgatatgaaagaagtcatcgataagctgcagaatcaatatgaaacggaccctgtcttcttttctgacagagtccgcattcaatatcccgactattggaagaaagtgaagcatcactgggatgaaaccttctccgaagcggcctttgactatgatgtttccattcagattaccaacttcggaacgatggggcggtagccttcagcgtgttttttcgacacgaaggagaatctgataaatccggctttgttcgggcagctgtgtcaccggaaattgcatcgattgcgccattcgtgtgatttcctgtaaaaacagctgcacccgctcatccacgtgaacatacgtataggactgctttttcacgtcaaatgtctcttccggaaagagcgtgcgcaccgtctgcggcgtaaaaaaccgcaagtgggtgcggtcgagaatcccggcgtctctgtatgtccagtccccgagcagaagcgggaacagcgcttcggcgtgggaaatattcggaatgctgcaaacgattgatccggcaggcgacaaataggatgagtacgtttcaatgacgcgccacgggtcttttaagtgctcaaggatgtccgcgaaaatgatgcaatcaaaaaagccttccggataaggcagcttcactttttcgacatcttcctgcagcaccgcttcataatgtccttttgccgcttgcgccgccagcgggtgcagttctattccgtacagttcgcaaggctgtctgttttgaagttccagccccgtagctcccgcaccgcagccgacatcaagtatccgtttcgcctcccggggaacgagctccgcaatttccggtctcggatgagtaaagtacgtaaaatcagtgccccatttttccgtaaaacgctggcggttctccgaatataactgattgatattgatatcctgattagccgtaaacgtcgcatgcccgtggtgatgcacaaaggcatcgagagcgatgtgcaggctgtatcctttttgcagggcgcgcagacataggtcatcatcttcaaaagaaccgtatccgaattgctcatcaaacgggccgatgtcttcaatgacgctttttttcaccagaagacagaagccgacaaggcgcagcacccgctttgtttgatgcttttcccgtgcacaatacgcctccgcgaatgactccagctcatcaagcgattgatacgcgtcatggatcatttgcgcgccgctgacatagttgctgacgggcccgaccataccggttttttcagattgatacagcaccctcagcatggaggtgagccaatttttcgtgaccatcgtatcgttgttcaggaacagcagattttctccccctgccgcttcgattccctggttgcaccccttggcgaacccgaggtttttttcattaaggatgactttgacgtcaggcagatttgatatgtattctctcgttccgtctgaggaaccgttgtcaactataatcagttcaatcttatctttgtcggtgtatcgtttaatgctggccagacattttttcgtcagctcaagttcattatatgtaaggataataatactcgttttcaccggcatccccgcctttatcgtgactttatacaacgtatgacatatccccgtcatttatgtgaccgtgcgggcgcccgcacgcatccgttttgaggggccggtgaataaccgcccccctaaaactgaatattacggatgaactgtccgccgatttgattctgatcccgagcctccgttacggcttttcagatcctgctcaatttcttcaaggcttttccccttcgtctcggtcactttaaaccggacgaacaggaatgccattattccgatagcggcataaatgagaaataaatagctgatgccgactgcttccattagcatcggataggttaatgagacaatcaatgttccggcatgcagcatcaaagtggagacacccgtcccgataccccggacatgcagcgggaataattcaggaagcatgacccacacggcaggcccccagctgaccgcaaacacaatgataaacaggcctaaacaaatcaccgttgtccatgatgcggctgctgaatgttcaaagaaaagattgaccgcggccaatacgagcagactgatgaccatgcccgcatttccggccagcagcagcggcttccggccgatcttatcaatgactttaatagccgcaagcgtcatgatgacattgacggcgccgattccgaccgttcccaatatagacgcggaattgccgaacccgacactggtaaatgttttcggtgcgtaataaataattgtatttgtcccgatgaattgctgcaaaaaggcaagtccgaggccggcaatcagcgcgggtctcacccacggctcaaacaattctttcaagccgccttcgttttccttttccgcttctttcatctgatcaatctcatcatcaatattcttcgttccccgcaatgatgaaaggatttctcttgctttctcttctttgccgatcgtaaacagccagcgcgggctttccggcataaataagattccgatcagcagaatgactgacggcacaaccgcaagtccaagcatccagcgccaagcgcctgcatcggcaaatatatagttcacgatataagaaacgaggattccgaccgtaatcatcagctgattcagcgaagaaagcgccccccgtttatgcttcggagccagctccgataaatagagcggaacgatcgttgtagatgttccgacagccagtccgagaatgatccggaaaagaaccatcacctctgtattcggggcaaaagcgactcctaaaccgcctatacaaaacagcagcgccgctcccatgatggctttccgcctgccgaaccggtcggtcagtttgccggcgaatcccgatccgagaatcgcccccgccaataacgaactgacgacgaggccttctgtaaaggcgttcagtcccagttcttttttcataaataaaatagctccggaaatgactccggtatcatatccgtataacgcgcccccgagagcgccgaaaaaatagagccatttattcgagtgtatgcttttcatgttatatagactcccttcatccaacgctgtatccgcgcggaattgttctactgcttcttttgcctgtttccgatcgtttcaaaccttccgcaccgttaatatccattattttactgattatttttcacaaagcgacgaaacatttcccgcttcctgccgtccaatataatgtgaacctgatgcaaaaataacagtagatgttgtcgaaatagagagaaagatttagaattttctcatttgcagagttgctccgagtcaacaattatggtacgcttcacaaagaatagaaacgagaggtaatgatatggaagaacgatctcaacgcagaaaaaagaaaaaacgcctcagaaaatgggtgaaatttgtactggtattcgccgctttcttattggtgatcgccggttccgtcggcacctacgcatttgtgaaattgaataatgcgaccaaagaagcgcacgtcagccttgaccgcggcgaccagtccgtaaaacggatcaaagaatttgacccgaagaaggattctttcaccgtattgcttttaggaatagacgcccgtgacaataagggtgaatcagtagatgacgcaagaagtgacgccaacgtgctcgtcaccttcaaccggaaaaagaaaacagcgacgatgctcagcattccgcgggattcctatgtcaacatcccgggacacggctatgacaaattcgcgcacgcacatgcttacggcggttataatttaacttataaaacagtagaaaacatgtttgatattccggtagattatgtggttgagagcaacttcgacgcgttccgcgatgtcgtcaatgagttgaacggcgttacggtaaatgtgaaaagccagaaaattgccgatcgtattaaagtcgatacaaaaggaaaagtcgtgctgaagccgggcgtccagacgcttgacggtgagcaggcactggcttatgtaagaacacgcaaagcggacaccgatctgatgcgcggacaaagacagatggaagtgctgagcgccattattaaaaaatctaaatcgttaagctcgatcccatcttatgacgatatcgtcgacagcttagggaaaaacttgaaaatgaacttatctcttaatgacgccatcggtctgttcccgtttatcacatcgctgaaatcggtgaattctttgcagctgacaggttcagacagctacatttacactcctcagtacggcaaaaatatttattacttcaagctgaatgaggaaaaccttcaagaagtaaaaacgaaattaaaaaatgatttagacgcgtaagatgtcacggcgggattagcaaatcccgccgtttttctgttgaaaaaaaggacatgaaggtatagccttttaactgacggctttctgctgatttcgcacaaagctgaacatactacatgaagcagctttatttttaaggagggcatccatacatatgaaattgatagccattgacttagacggcacattactgaattcggacagtgtgatttctccggaaaacagagcggctttacaaagagcggatgaagcgggcattctcgtggccatctgcacgggcagagccacgtttgatgtaaaagcgctcttgaaggatttggatattccgatcattgcggcaaacggcgggacagtccatgacaaaggataccgcctcgtcagccggctcttgatggatcagcaggccgggaaggatatcgccgcttatttaacggacaaagatatttactttgaggtctatacagatgatcatctgctgtccccgtttgacggcgagtccaaactgcaggcagaactggacattctgaaaagcgccaatcctaaggaagatattcagacattatgggagggcgcaaagacgcagtttaaacaattcggcattaaacccgtacaggatatacaggcgatttttaacggagacgaacatgtttacaagcttctttgtttctcttttgatatggaaaaactgagaaacgccaaagaagaaattacacatcatcggaaattatcccagacatcttccggaaaacacattatcgaaatcctccctgccggttccggaaagggacgtgctctgacggagcttgcctcactgtacggaattgaaaaacaggatatttacgccatcggcgacagcccgaatgatttctccatgtttgaagcggcgggaaaccgcatcgctatgggcaatgcgattgatgaattgaaggaaaaaagcacctatattacaaaaagcaacgatgaaaacggcgtcgcatatttcatcaaccggcttctcgacaacgggaaataaaaggtaaaagccaggtctttcacggcctggctttttcatgttttccaaaaaaggaatttccaaaattgaaaataaattgtaagataaagaaaaaaggagtttcatgatgtcgaatgcaatcgctattataggatttttagcttttctctgcgcagtcggatacggaatttttcatctcatatgcaaagcggcaaaaaaagaaaaacatttttcaaaaaagctgttttggcctcttctcatcggcggatttatcctgcttctgaccagtgcatccctcgcagagccggacgcctcggccgtgaaggcagaggagaaatacagcacccttgatacggcttatcaaaaattgacgaaggaacaccaggcgcttgagaaaaaatatgaaagcatcagtgccgcagccgaaaaggagaaatccgaagctgaagccggcaatgaagaaaaactcagcaaactcagccaagagataagcgagctgaaaaaaacaaacaaatcactcaaacaagacaatgagaaattaacaaattcacaaaagaagctcgaaaagaccgctgaaacgcttcagtcagaaaataaaactttaaagcggcagaaagcagaaacaaaaacatccgaaaatgcggaaacggcgcaaaacaacgcctcttcctccggaggacatgccgaaacgaaagcagccggcacctcacagggatgcgacattaaaggcagccggaacggcatttatcacacgccgggaagtacatactacgaccggacgacagatcccgcggaaatgttctgttctgtagaggatgcggtagcggccggatacagagcgccgaaacggtaaaagaaaaagacgtcagagacactctctgacgtctttttttacggaagccggatgccgcccgcatatttgtccttccaataagcgcttgtgttcatatttgttatggtaacacctgcggacacggtgacatgaatcacttgtccgttcccgatataaatggccggattcaggctttccgctttaaagaagaccagatcgccgggcttcagatcttgtttatcgaccggaacgcccgcctgcatctgcttgtcggcataacgcggcaggctgattcctttcgctttttgatagatgtattgaacaaatcccgccgtatcaaagccggcttccggtgaagcgccgcctttcagataagaaattccgatatgatcggccgctgtggacacaacgggattgtctttagaaatggctaaattgctgaatcggcgcacccctgtgaaatgttttttccaataatcttccgccaagtaagaaatggtgactttttcggagcggcttgcttggatgaaccttccctctcccgcataaatgcccgcatgggaaattccttttttatacgtgtcgctgaaataaatcacgtccccgggctttatgtcgctcagtttgattttctcaccgaccagccactgctgttccgcagatctcggcaggtaaatgtgaagcttgttttcaaaaacatattggaccagccccgaacagtcgaatcccgcctcaggcgtgcttccgccgaatacatacggaatgtcgaggtaacgggctgcctcctgaacgatcggatcatcagccagttccggatcttttgtcatccgctttgcgccaagatataaattcatccaataactgcttttttgaaagcgtgtgacggttacgccttctgacggagaactgtgtatcatctctccgtttccgatatacagaccgtcatggacgggcgcgttttgtgttgaatccgactttttgaaaaacacaagatctcccggtaaaaggtcattttctttgacggcggctccgactttccattgatcactgaccgttctcggcagatggatgttctgcctgctgaaaagataatgcatcaatccggacgggtcaaaaccgtcctcaggctcttcgcctccgtaaacatatttatttccgacaagtttttgcgcgtctgaaacgatcaggacagaaacttgagaatccgcttcggcaatttccgttctcgttactgcaggtgccacaagacaaatcataaggccggcaaggatgtacttcctccagcttgtgagcatgttttctattcactctcctcatttttagtagtttttacatcggtaacttttaacaaatgtttaggagagcacacaaaaaaagaatgcccgatatgggcattctttactggattcggaacaaacaatatgccggcaagcggaatcatgcgcttattttgcgcccgctgtgtcctcttgctgaattttttgcatttccgtgtcaattttttgtttttcctgatctgtgagctgatcattgtatttaaacgcagacataaacataaacaccataatgatcgcggcaaacggccatcctgctttaatgattttcatttgtttttcactccgctttcttttttaagatatcgctgtgatccacatcaaacgttaattttccatccttgacgctccacttgaaattcgattctttcgtcagttcacgtacgatcgttttatgattgatgctgccttttttaaccggtgcaggcgttgcttcatgaatgttcatcggcgtgacttcaaagcgtcccgtaccgtttttctgcagatgatattgaacaagcgccgtgtctctcgttcttgtccacccctggtcgaatacgaagttgcccaggctgtagaaaataacggtgccgtggtacatttcgatcggttccagcacgtgcggatggtgtccgacgataatatccgctccggcatctgacattgctcttgccaattggcgctgtctgtcattcggatcattatcgtattcctgtccccagtgtgtttgaacaatgacaagatcggctttctttttggctttagaaatcatcggaataaacagctctggatcggccggaagcacacccggcgcatttcgtttagctgcaaaaccttttccggaaacatcagtgaaacccagtgttgcgattttgattccgtttacatcttgataagaaatgttctgctcggcttccttcagcgtgaggcctgctccgacaagttcaagattttgctttgaaaactcttcaaccgtatcccgcattccttgagggccgtaatccatcgcatggttgttggctgccgtgagaacggtgaaattcatgtccttcaatacttttacggcatctttgtttgactgaaggtggatatttttttctgcttctttgtagttctttttatatgtaaccgggttttcaaagttccctgacacatagtcggatgcttcgaagaatggctttgcataacggaagacactctccgtgcctttatgctttgtcactttctcgacattccggcccatcataatatctccgacgaacgaggctgatacaaggtcatcggcatttcttttcacactcggcgtttccgccttccctgtcaggatgcagacgaacatcaggcaaaagacgatcggcagcgcgataaaaacgtgaagattggtcttctttttctgctgtttggtcagcttcagcagtttttcttgaaagcttaattgttttttcatcgtttgacacaccttacattagattaagtagtaagcaaacataatggcaaaagttgcgccgcttaagaacagcgtgctggcgaaagtaatcgttaatccctgtttctgaatggtattggcgatcagacccggtacgatgataccgattccgcggaattctgatatctcaaacggtacgatcgggtaaagaaaatcaagggcgatttttaagcagattcccgttatcagcatagctgcgaattttctgcgtccgtacaatatcataaatctggataaaccgtatttgacgatcacgtatgtaagaagactcaccagcagtacgagtaaaataaagaccggctggttaaatacgagccctaaataacccggcacaactaaaccggcaggtacgatacctgttttttccgcgaaaattaaactgattaacacgcctaaaataagtgaaatgtataaatctgatccgaacatttatccttttcctcctagctaacgagctgtttcaccttatactcttggattttttcaattaatggttccgctgaaccgtggatattgccgacgccatatatgacacggttttgcattcttgttttcagcacgtccatgatttcgtctgttgatttatattccagatcgtgcagtgtatcggcaggaatcttgccttcttcataagctctgacgatcggttctgtcgtctcgccgatgagtatgagttccttcgttttaatgtacggaagcacgtcgtttgcgaactgaatcgttctgtccacacggtcggcgcggcagttcatgatgacgatcggttcatctgtcgggtagccgatttcctttacacgtttccatatatttaaagtagaagatgcatcatttgcggcaaagccgtttacgaaatgaccgggctccttcgtgctgagcagcggcaggattctcatggcgccaggatcaggcggcgcgttcagcattcctttaaacgccgtttcttcatctatcccaagagcctgggcaacgccgagcgccagggaagcgttatcaggaaagaccatatattcaaattttcgaaggtattcatctgtaattttagagttatccgcaataatgacctcggtattccgctctgcggctttttctttaaagaagtctgtgtattcactgtctgtaatgacaaggtgaccgttatacggtatcgtcgcggtaaaagcttcagcaatctcatcaagcgtcggccccatgacatccatatggtcttcaagcacattcacgatgacgccgatgttggcttgaaggagttcttcctgaaagataatctgataatccgggtttaccgccatacattcactgacaatggcattggcgccccgttctacggtttccttcattacttctttttgctcgccgatattcgggccctgcggtttccgtttgatcggtttctcctcaggtgtatcccaatagatcatccttgcatctgttcccgtcgtttttccgactgttttgtagcccgcctccatcagtattccggtcgtcagcctcgttacggttgactttccgcggataccattaatattgacgcgtactggcagagcatcgatattcttctgatgccgccttttttcaatgattccgatgattagtacggcagcacaggctataatgagtaaccacattgatttttgacatctccttctgtattgataaattcattcatcagtatatagcttcactatgaattctcaatcggcattatgtaacataatcttcccgctttcactgagccaaacttctctattagtgacgctattcttcctattatcgaattgctttttttgggaataggcaggacttaaaccttacttcaatttttcaaaagaaaaatgtatgcgtttacatttccacacagaaattcatttggaccaatgggactatacgcgttccggaagaaaaagatgtaatgataatccatcttttacagcctgttatatcagcgttttccgcactgcgcatacgtttcgggactctatgtccgctgtgtgcagactgcctgttttgttaaggataaggtcttaaagtcattcatttttcccccgtatcctgctttcagtcccattccaaaataactagcggaatgactggtacgtgacagaaaaagacgggtccggagtgtttacaagaaatacacattttatatgcggaaagcctatctccttttaaagcatttacaggacatttatcactcttttgaaataattttaataaatctttatattcgttcaagaaatattcatccataattgtgaagttcttggtaaaacgtcgagaaactcctctattttataaaatgcataaaaaaggaatacccgctgaaaactacaaataaccgggaaaggaggcggtctgatgtctgcggataaacaaaacaaacggatttccggcgattttgaatcggctgtacgggaaatgcaggagctgatgtgtgtttgcggtgattttaaaatacgaaggatcaaactgcaggaccgtcataccgctttcttttatattgaacaaatgatagaagaacagaagctgaatgagtttctgttaagcgacaccctgcagaacggtccgcttgaggaaacgatgaatgccgtcagcagtgcggaaacggatgaaaccagaaaactcattgacgcgattttggcaggccaggttgtttttctcagcgatgcatcaaggaaagcgaagctgttttccgtcgggcagaatccgctgcgttccattatggaacccgaatctgaaagtatcgtccgcggcgcccatgacgggtttgtggaaagtttggaaacgaacattcatcagctgcggtttcacatacaggaccgccatctctccgttcattatatggatatcggggaaagagccaaatcaaaggttgcggttatctttgttgagaatatcgccaatccggagattgtggaggaagtgaagcggcgcctgtcatacctgcgtatagacagcgtgcttgcgcccggaattatcgaggagtcgatagaagataattcgttttccatttttccgcagatcgttcatacggaacggccggataaagcaaaagcatgcgtgatggaaggctgtgtgctgatcatgatggatggcagcccgtcggccttgattgcgccgatcacgttcttttccttttttcaatcgccggatgactacagcacgaggtggatttccgccagttttttgagagtgctgagatttttcgcctttatgatcgcgattacactgcccgctttttatatcgcgctgattgcgtttcattttgaagtcattcccaacgatttgattatcaccatgaaaaattcgattgttgatattcccttccctccgctgatagaggccatgattatggagattacgattgagctgatccgcgaagccggtatcaggctgccgaaaccgatcagtcagacgatcggcattgtcggcggtctcgtgatcggtgacgcagtcgttcaggcgggactcatttctaatatgatgattatcgtcgtggccgttacggccgtttcttcttttgtgcttccttcatatgaaatgagcacgtccattcgaacgctcagatttccgcttatgtttctggcatcctcgttcggttttatcggcatcgcattcggcttcggacttattctgatgaacctgtgcaagcttgaatccctcggcgttccgtatttatcatctctgacgccgtttcatttcagtgacttaaaggatgcatttatccggctgccggcctggtttattaaaagaaggcctttttatttgagaccgcaagattcaaagcagataaaacatgttcgggggtggagaaaagatgaagcctaaaaaaatcagccggcttcaaggcgtgtttttcattaatcagacgcagatcagcatcggcattttggcgctgccccatttactgatgatgaaatcgggaagcagcggatggatttccattctgcttaccggattgctcgtccagcttaccttcagcctgtatatgatattatttcaccggtttccgaagctgaacctgtatgaaatgctggaggaggtgttcggaacacttgccggcaaaggggtgcaggtgctgtatattttatatttcgcgtttctctgcacgctcattctttctgtatttacacggttattggatatctgggtgctccctcagactccgaattgggtgatcagcttaatgctgatcctcggttctgtctatatcgcccaagccccgctgaatgcgatcgcgaggttcagctttattttaacgccgtttttgctgctgatctctctgccgcttttatacacgctgggaaaagccgatatcacatacattatgccgatttttcacggaaccgcaaaagacatggttaccggggtgcagcaaacacttgtcagcattaccggctttcaggcggcgcttgtgatcgggccccttatcaactgcaccgtcagccagcgctacaaaatactgacgatttcaaacatcttgattatcctttattacctgtatatcactcttacttgctttgtcaccatcagccccgaagaaataaaaatgatcccggagcctgtgctgtacctgttaaaaaccgtttcattcagaattatcgaacggacggatctgctctttttgacgttttggttcgtgaccgtcttttcaacgctggccaacgtgttttacttggcaagcaccggcatcgccaagctgttcaatcaaaaagatcacagccggtttgtttatccgctggccctgctcgtcttccttctgtctatttgggccacaagcacagataaaacgatacagcagctggatcagtttttccgcatttccgatattgtgtttgtgtatttgtttccgttgtttatggtattgattgtccttgtacgcaaaaagggtgtccgccatgcgcattaaaaaagcggttcttatcagtctcatgtgcgcaagcctgacacttgccggctgctgggatcaaaatttgttgaaagatatttctctcgtgctgaccgcaagccttgatgttgatcatgacggtaaaaataaaatcggcattacctatcggaaggttcagtcctcccaggcggaacaggaaacgggcggctcattcattacgacggtgctcagcgcttccgggcacaccatccgtgaagcgcggtttcaattggataagcttgtcgaccagcgcattgacacgtccaagcaaagagtcttattaatcggtgagaaaatggcggaaaaaccgctttttccttatctcgatgtcttttacagagatccgaaaagtccgcttctcgctcatccggcggttgtaaaagacggcgaggcgattgaagtgctgaagctgatcgtccggcagaaattgatcgtcagcaagtatttaacgaatttattaacaagcgctaatgcggaatcaaatatcagcatggaaaatttgcaatccatccgttcaagcatgctgacggctgataaggatttcgcccttccttatttatcgattaacggacagacgataaaggtagagggttctgccctgttcagcggccagcggaaagtgactgaggtgctcggtcaggattcgaccctcctgacccttttaagcgggcaatttaataaatcggctaatattaatctgaagctgtgggacaaatacaaaatggatattgaaaattatctttctctcggcatcacggatgccacgcgaaagattgtatttatagatacagatccgcagcatataaaagtgaaaatccgtttaaagctgaacgcacgcgtcttggaatatccgaaggacaaactgaattcttatacggcaatcgaccaaatgaacaaacaagcatcagcaaatttgaacagccaggccagatcggtgatcagccatattcaggagcacaactcggatatcctcggcatcggccggaaatatcaaacccattattatgagcggggcaagcggctcaattggcgtgaggtctatccttccatcgagataatccctgatatcaaagtgaatatctcgcaaatcggcatcgtgaactaaaagagaccccggtctctttttttgttgccaaccgaaatgattcgtggtactctttttgtgtaaacggttacataaatgaaggaggagtgtttgttggcaacgattaaagatgtcgcaggcgctgccggcgtctctgttgccacggtctcgcgtgtcctcaatgacaacggctacgtccatgaagatacacgaacgaaggtcatgcttgccatggagaagctgaattattatccgaatgaagttgcccgctctctttataaaagagaatccagactggtcgggcttttgcttccggatattacgaacccctttttcccgcagcttgcccgcggcgctgaagacgagctgcagcgggaaggataccggctgatcatcggcaacagcgatgaagaattggaaaaagaactcgactacctgcaaacatttaaacaaaatcaagttgccggtattttggcggccacccattaccccgaccttcccgaatacagcggcagcctttacccggtcgtatttctggaccggacaaaagaaggcgccccatccgtattcagtgacgggcgggcaggcggaaaacgggcggctgaggaaatgcttcgcggcaaaagcacaagcatcacgcttgtcaaaggcccaggccaccttccgaccgctcaggaacgttttaacggcgcacttgatgtgctgcaaaaagcgggcgcgcagttcaatgtcatctccgccgcttcattttccatcaaggatgccgccgttttagcagaaaaattgtttacagcataccccgaaaccgacggagtcattgccagcaacgatattgcggcggctgccgtcctccatgaggcgctgcggctcggtaaaaaagttccggaggagattcagatcatcggatacgacgatattccgcagagcaggcttttgtttccgccgctttcaaccatccgccagcctgcatatgagatgggaaaacaagcggcaaacctgctgctgcaattgataaagaaagagccgccgaaagagacggccattcaaatgcccgtgacttatataaaaagacaaacgacgagaaaggatgatcaccatgagtgaaatttgtgttatcggaagctgttctatggatctggtcgtcacatccgaacggcgtccgaaagccggagaaaccgtactgggcacagactttcaaaccgtgcccgggggaaaaggcgcaaaccaggccgtagccgcttcccgccttggcgcgaacgtatatatggtgggaaaagctggcagtgacagctacggaaaagcgattattgaaaacctgaaggcaaacggtgtcaatacggactatatggaaacggttacacataaaaaaagcggaacggctcatattgtgctcgcagaaggagacaacagcatcgtcgtcgtaaaaggcgcaaacgatgacatctcacccgattatgccaaaagtgcgctggcaaaacttcccggcattgatatcgtgctgatccagcaggagattcctgaagaaaccgttgaagaagtgtgcagctactgccgcgcgcagcaaattccggttatcctgaatcccgcgccggcccgcccgctgaaacaatcgacgattgagaatgccgcatatcttacgccgaacgaacatgaagcatccattttatttcctgaccggacgaaagaagaagcgctcgccggctatcccggcaaactgttcattaccgaaggaaaacaaggcgtacgctactcagacggcaccgcggaacggcttgttcccggcttccctgcagaagcggtcgacacgacgggtgccggcgatacctttaatgcggcacttgccgtcgcactcgcggaagggcgggacatcgagcaagcgctccagttcgccaaccgcgccgcctccctgtccgtgcagcacttcggcgcccaaggcgggatgccggtcagaaaagaagttgaggagctgctgtcatgaaaaaacacggaatgttaaacagccacattgccaaagtattagccgatctcgggcatacagacctcatcgcgatcgccgatgcgggtctccccgtccctgacggcgtccctaaaattgatttgtccttaacggcgggcattcccgcctttcgggacgtgaccagcctggtagccggggagatggccgtcgaaaaggtgatggccgcctccgagatcaaagacgaaaatcctgagaatgcaagtttcatagaaagccatttctcagcgcagacgatcgagtacatgtcccactcggaattcaaacggctcacacagaaagcaaaagccgtcatccggacgggtgaaatgacaccatacgccaactgcatcctgcaggcgggtgtgattttctagaaagaagggatccagcatgcacatcggcatgacagacattcataaagcattcggcaaaaaccaagtgctatccggcgtctcatttgagcttctgccgggagaaatccacgctttaatgggagaaaacggagcgggcaaatcgacgttaatgaatctgctcaccgggctctaccggctcgacaagggaaacattacgataaacggaacaaatatgaatttctccaatccaaaggaagccgaaaagcacggaatcgcctttatccatcaggaactgaatatatggccggacatgacggtgcttgaaaacctttttatcggcaaagagctgacgacggcgttcggcgttttggaaacgaagaaaatgaaagcgctagcaaaatcacagcttgaaaaactgggagtctctcttcctcttgaccgggaagccggacaatgttccgtcggccagcagcaaatgattgagattgccaaagcgctgatgacaaacgccgaagtcattattatggacgaaccgaccgcggcgctgaccgaacgggaaatcagcaaactgtttgacgtgatgacggcgttaaagcgggacggcgtatccattgtctatatttcgcaccgaatggaagagatattttcaatttgcgaccggatcaccattatgcgggacggcctcactgtcgatacggcgcatatgaaagatactcattttgatgaagtggtcaaaaaaatggtcgggcgggagctgaccgatcggtatccgacccgcacgccgtcactcggcgataaggtgctcgaagtgaaaaacgcctcaaaaaaaggaagcttttcacagatcagtttccatgtgagcgccggagaaatcctcggcgtttccggcttaatgggtgccggacggacagaaatcatgaggacgctgttcggaattgaccggctcgattccggagaggtctgtatttccggccgaaaaaccggcattcggggtccgtacgatgccatccgcaagggactcggcctgattacggagaaccgcaaagatgaagggctgctgctggatacgtccattcgtgaaaatatctcattgccgaacctgaccagtttctctccgaaaggcatcattgaccgaaaacgcgaggcggagttcgttgagctgctcatcaagcgtctgaccattaagactgcatctccggaaaccgccgcccggcatttatcaggaggaaatcagcaaaaagtcgtcatcgccaaatggatcggaatcggcccgaaagtcctcatccttgatgaaccgacaagaggcgtcgacgtaggcgcgaaaagggaaatctattcattaatgaatgaactgaccgatcgcggagtcgccatcatcatggtttcttccgagctgccggaaattctcggcatgagtgacagaatcatcgtcgtccacgaagggcgcatcagcggagaaatcaatgcggcagatgcaacacaagaacacatcatgacacttgccacgggagggcagcagtatgaaaactgaaccaataacatcaactgaacaaaagcgattttccattcataccttcacgcaaaaactcggtccgtttctcggcttactgattcttgtgctgatcgtttccgttttaaacccgagttttcttgaacctctcaatattctcaatcttcttcggcaggttgcgattaacgctctgattgcattcggaatgacgtttgtcattttaacgggaggcattgatctctctgtcggagccatcctcgccttatcgagcgcattggtcgcaggtatgatggtctcaggcatcgacccgatcttagccgtcatcatcggctgcgtgatcggcgccgtactcggcatgataaacggattattaatcacaaaaggaaaaatggcgccgttcatcgccactttggcgacaatgaccgtctttcgcggactgaccctcgtctatacggacggaaatccgattacggggctcggttcaaattacgcatttcaattattcgggcgcggttattttctcggcatccccgtacctgccattacgatgctgattgcatttgcggccctgtgggttcttctgcacaaaacaccgttcggccgccggacatacgccatcggcggcaatgagaaagcggcgctgatatcgggaatcaaagtgccccgcatcaagatcatgatctattctctgacaggtttattatcggcgctggcgggagcgattctgacatcacgcttaaattccgcacagccgacggccggagaatcatacgagctggacgccatcgcagcggtcgttctcggcggaacgagcctgtccggcggtcgagggcgcatcatcggtacgctgatcggggttttgattatcggtacgctgaacaacggcttgaaccttctcggcgtatcatcattttatcagctcgtcgtcaaaggaatcgtcattttaatcgcggtgctgctggaccgcaaaaaatcggcatagtaggaggaccattatgaagaaagccatcatcacgatcgcggcattatcactgtttttgctgtccgcctgttcacttgaaccgccgcaatgggcaaaaccgtcaaacacaaaacataaaaaagaattcactatcgggctctccgtctccacattaaacaatccgttcttcgtttcattaaaagaaggcgttgtaaaggaagccaaaaaacggggcatgaaggtcattattgtcgatgcccaaaatgattcatctaaacagtcaaatgacgtagaagatttgatccagcagggagtcgatgcgctgctgatcaatccgaccgattcatcagcgatttcaacagccgtcgaatcggcaaattccctcggcattcccgtcattgcgcttgatcgttcagccgaacacggcaaagtcgaaacgcttgtcgcctctgacaatgtcaaaggaggagaaatggcggctgactacctcgccgatcagctcggaaaaggcgccaaagtggctgaattgcaaggggtgccgggcgcatccgcgacacgggaacgcggaacgggctttcatcatattgccgacaaaaagctggatgtcgttacaaaacaagcggcagattttgaccgtacaaaaggattgaccgtcatggaaaacctgctgcagggacatccggatatcaaagccgtgttcgcccataatgatgaaatggcactcggggcgctcgaagcgattaacagctcgggcaaacacattttggtcgtcggtttcgacggaaataaagatgcgatttcttccattaaaagcgggaagctgacagccacggtcgcccagcagccggagctgatcggaaaactggcggtcgaagcggcggagcaggtgctcaaaggagaaaaagtcaaaaaaaccatttccgctccattgaaacttcaaacgcaaaaataaccggccgatgtttagacttccggtaaaacgtgaaaggatgaagtaaaaggagagatacagatgaagaaaacagccaaagcggcatccatcctgacccttgcagcgggaatatcagcggcttcaactgccggaataacgcctcttcccgagacacacgcgcaagaagcggtcaaaattgacgatctgtacagctacccgcttgactcttatcttgtttccgcggaagcattgaacgtgagaacaaaagcatcagcagccagtccgagagctgatacccttcatttaggcgacagcttaaagatcgtttcattccagaacgctgactgggcaaaagtacattataaaaacggaaaaacaggatttgtatctactcattatattgttaaagaagcaacaaccgtaaaaacgacggcaaaaacaaaagtatatacagacaaacaagcggtcaaagcttcccttgccaaaaacacgagcgtttctttcctcggatggaaaaagacagccggcggcggcattgatttcggctgggcgcttgtcgattacgggggcgcaacgggatatatcagcacaaaagatctgcaaaaactgacataatatcaaaacggatttcgcaaattcagcgcgaaatccgttttttctttcttgagcagtcagaaacgtctaaggttcgaaatatttctcaggaaatattgtcggatgaagatgaatgcatacgactctaaaatggcttctttatgtaatccgccaggcgtttggcgttgtcacggatagccgcagcatcggcgctgctaaccccgtacatcgcgaaagccggcaaataggtcattcccgtaaaattagccattgcctgaaacggccttaagagctcgctcagtgaaaaatggttggacccgcctgcctgatatgcatcctctccggcacctacagaaacagccagcagcaattctttgccgtgcagcgcctttcctttggaaccgtaagcccagccatacgccagcacatgatccatccatgtttttaaaagcggaggcgcactgtaccagtacagcgggaattgaaatacgatccggtcatactgttcacacagctgccgttccttttccccatctattttcccgtccggatattctttataaagctcacggaccgtgatgtcatcatgattttttaattcttctgtccacgccttattgaccgctgagttgtccatgtcaggatgaaccgctaataccaatactttcacagctaccacacctttcccttttgactgtattttacctaatctttgccggttcagccaaataaaaagaaagcccccgagaaaaatgaggctttcttttttattttattccgggcttccttcggttgtttcaatatccttcgcaaaattcggattatctaaatttgcgttgaaaaagtccgccgtattcggaagcttgaggttcatattcattttttgagaaatggtcactttacaatctttaatgacatagtcaaacacgtgtcccccggaattgcgtccttcatcaatgaagtgcaggtgatatccggaaacagcgatgccgtttgcgtaacccggcgtccagaagccggcgattgtaccctgaatgtcgtcaaagttgaacacaggctgtgttttcaccgcttcaatcatcggaacgtacggtttctcctggcgttctaccgttcttgtctgcacctttttaaatacgccgtctaaacggatcgcataaaataagtttttactaggcagaaggctggcgatttcctgctcgaattcttcacgggtcatttcgccgtcgatcgtatgcgtcatgtccggcgtgaaaaatgtgaatgagcagaatggtgacaggtctccgcctttaacaggcgtagccgttccgtcgccgcgcagacggtaaaattcgccgtcaaatccgattaattcgccgtccagtttattgaacgtgccgatcccgaaatcaccgaacttcggaatgtcagccatatcaaaatctccgtcatacactccgtccagcagagatgtcatggtggatacttgatagatttgatcctcaggtgagcctttttctccgcggctcatcatatggatgtcgcttgcatttttcatattcccttcactccttttaaattgggctgttttagaaaacaggtcatggtgcgcagagtgctagagagcttttgctttcattttttctttgaattgcttcggaagcatgtcgcttgataaatggacattgtcactgtaatcgacaggaatgtcaatgatgacagggccttctgtgttcaagcctttttgcagcacgtctgccagctgttccggtgactcaacgcgcaagccggtggcgccgaagctttctgcatattttacgatgtcaatgtttccgaaatctacgcatgatgtacggttatattttttcatttgctggaatgcgaccatatcatatgtgctgtcattccatacaaggtgaacgatcggcgcttttaagcggactgccgtttccaattccattgcagagaacaggaatcctccgtctcctgaaacggatacgactttttcacccggattcaccaatgtggcggcaatcgcccaaggaagcgctacgcccaatgtctgcatgccgttgctgatcaacagtttcagcggctcataagcgcggaagtagcgggacatccagatcgcgtgagaaccgatatcgcaagtgacggttacgtcgtcatcaattgcattgcgcagttcttggacgatttgcagaggatgcactctgtcggatttatgatcgcttggcgccttctcgctgtctgtgagcatctgttttaactcgctcagcacttctttttcacggctgcccatatcaaatgtcacagcgtcgtgttcaatttgtttaaccgtagcggcgatatcgcctaataattctaattccggctgataggcatgatcgatatcggcctggatttcgtcaagatggataatagcacggtcaccgtttacgttccagaacttcggatcgtattcaatcggatcataaccgatcgttaatacgacatccgcctgttcaagcagaagatcgcccggctggttgcggaacagtccgatccggccgaaatattggtcttccagctctctggacaatgtgccggccccttggtacgtttctacgaaaggcagttttgttttggcaagcagtttgcggatttgttttaccgcttccggtcttccgcctttcatgccgactaacagaacgggaagtttcgccgtctggattttcgcgatagccgcgctgaccgcctcttccggtgcagggccttgtttcggcgccggcacgctgcgtacgtttttcacatttgtgatttcattcacaacatcctgcggaaagctcacaaaagccgcgcctgcctgacctgctgacgctgccctgaaggcgtttgttaccgcttctggtatattccctgtttcctgtacttctacactgtattttgtaatcggctgaaatagcgccgcattgtccaatgattggtgtgtccgttttaaccggtctgcgcgaattacgttacccgccagcgccactaccggatcaccttctgtattagccgttaacaagccggtcgccaagttggatgcccccgggcctgaagtaacgagacaaacgcctggttttccagtcagtcttccgacagccgcagccataaatgcagcgttctgttcgtgacggcataaaaccagttcaggtcctttatcttttaacgcatcaaatactgcatcaatttttgcacccggaatgccaaaaacatgtgtgacaccttgctccactaagcaatcaacaacaagctccgccccccgatttttttcagaggtttttagttcatttgttgcttttgccaacaccctcactccttattatgcatattaaatataaaattttaagtaatttgtgatattattcactatacactctttggaaattgacctccaatatcaattcgccgtatgattaatatgtttcacgaataattaacaaagagaaaggaatggataaggatggagcttcgccatcttcaatactttattgccgttgccgaagaacttcatttcggcaaagcggcgcttcggttaaatatgacacagccgcctctcagccagcagatcaaacagcttgagaaggaagtcggcgtgaccttattaaagcgcacgaaacgggttgtagagctttcagctgccggagaaagttttttaaaacacagcagaaacgcgatcgaagaaatagacaaagcgattgaaatggcgcagagaacggcgcggggagagctcggccgccttgtcgtcggttttgtcggctcggccacatatgaatttctgccgccgatcattcgggaattccgcgaaaaattcccctccgtcaagcttgatctgcgtgaaatttcttctttcagacagcaggaagaacttctgaaggggaacattgatatcggcatccttcatccgcctttacaacattccgcgttacatatggaaaaggtgcagagcagcccgtgcattctggctttgccgaagcagcacccgcttaccgctaaacagacaatcgacattcaggatttaaaaaatgaaccgattatcacactgtcgaaagaaacatggccgactttatacctggagtttgtaaactactgcgagcaggcgggcttcaaaccgaaaatcgttcaggaagcgacggagtatcaaatggtgatcggattggttagtgccggtatcggtgtaaccttcgtgccttcttctgctaaaaagctgtttaatctcgaagtcgcctaccgcggcattaatcaggcgcagctcactgccgaatgggtcattgcctaccgcaaggataatcaaaatccgatcctgaaacattttctggatattatgaataagcgccaggctttattgcaggcggataaggaaaatgcataaaaaagagggccgccgaaagcagcctcttttttttgtgcttttatggatttttactaaattggtagaaacgctcagtacaccttacgacctgtacccgtatacatacagtacaactgatcaggagggataaaaataacggggcggcaatgacccatcgaaaaggaggcagaacacattacacatattaccgtcattttgaccctgatttctttctttgtgaccattatttttatattttggagacccgggggattaaatgaagccgttccggcgtcgctgggcgccattctcgttttgttatgcggaaccgtttcctttcatgatttgggggatatagggtcaaaagtcaccggagcatcaataaccattatctccacaatgataatggcgatcgcgctggaaagcttcggtttttttaactgggcggcggccaaactgcttcaccgcgccaagggatcaggcatccggcttttttggctgaccaacctgctctgtttttcaatgacgctctttctgaataatgacggcagcgtcttaatcaccactcctattttactattggtcttacaatatctcggacttaaaagacatcagaaaacaccgtatttaataagcggcgtattaattgcgacggcggcaagcaccccgatcggcgtcagtaatatcgtcaatttaatttctctcaaaatgataggcatggacctttatttgtacaccaatatgatgtttatccccggcacgctgggactggtgtttatggcctttctgctgtttgccgttttctaccgccgtttgccgaaacagctccccgatattccggttcattttgaatcgctggaacacaaacgatatcatccgcttcagcctccgccagacttgtcccaaaaaaacagccgtacgaacatcatgttttgtgttttggtatttgtattgtttgtccggatcagtctgtttgcagcttcttacaacggcatatccgtttcgctcgtggctgtcatcagttcagtcatcctgctttgctggagatggttttatttaaaaatcggaccggcggacttattaaggaaagcgccttggcatatctttatttttgccttcacgatgtacattatcatttacggactgcataatatcggactgacggcattgcttgttcagtctattgagccttatgtctcacaaagcattgcccacgctgcatctattatgggcattgctacatccgtcctctctaatttgttcaataaccatcccgccttaatgatcagcactttgacattaactgaaatgtccatcgacccattaaccgtaaaaatcatttatctggctaatattatcggcagtgatatcggatcattgcttctgccgatcgggacattagccacactgatctggatgcatatcatcagacagcacggcgaaaaagtttcttggtcagaatatatcaaaacgaccattgtcgttgtccctctcaccgtcgtgtttaccattaccgttttatatgtttggatcagctggatttacctttagctatgaaaaaaactgcctgctgtataagagaggcagttttatcatttatggcaggtgcatggtttttaaatgattcaatttccaaaagacagtatccccgtctgcattggtcaattcaagaatattatctgagacgtcctgtaacagccccactttattcggtatatctcctaaatccagaataatcagcttcccgacatatctttttaattgctcctcaaaattccggacaaggggcacattagcgggaacaaccggcagctctgaactgtttaatgtatacggcgtctgctcatcggaatagggtgtcagccatttcaaatgatgcatcgagatgaaaagagtcttataaaccggagagaagaaaacaaaataatcatttaaaacacttgtcacatacccatgaatggaacggtctcccgtaacgaaaatttctgtaaatctgccttttatatgctggagggtattccggtaagaaaaggaatgttcctgtttttcgggatgcggacttttttttcttgcgtacggttctttattctcttcgtccgggagcgtcaatgtcatccgctgaagatgcagcagcggaatataaagaaacgtccggccgtcatgaatcacaatgatatcctgaccgatatccaaaagagttcctgaaaatgtcgtattccccgatatctcaatatcgacttgtttatccagaaatctgcttaatccagccatttcattccccctctcccgcgtttacggacaatctttccaatcatttacggccgtgtttccacctataatctattgtccttaatacagtggcgtagctataagagttctcttcctcccgttttgaggatcgaacggatcttgacgatcttttcgactttttagaggaagtacgctgctcttcgcgagattcttcttcatgtgacttttcttcttcggcgctctctttcccgcctttattctcgtcgtctttattctcttcttttttggctgctccttttgccccttcgctgatgctcttgatatgaaaaggatagatccgcagcacttctttatctttcacaagagtgtagtggccgtcggaattatccacaagtataccttcaacggcttcaggacctccgcggttgatggatacccatttgtggatcaggcgtttaaatatgccgtgaaaatcatcagccatttcaaattccgggcgctcctcctcctggccgtcctcttcttgttccgcgctgatgcttttgacatgatcggcgttaaaatatacgattccgtcatcttctgtttccagcacgagaaaatcatcccctgtttcgtgaagctttcctcttttcgattccggacctccctgattcaattgcaccgtgcgattggtcatccggctgatcagatcttgaaaatcatcagctttttcacattctgccgcttcggccggcgatacggtttcactcgtattttccgtcacactcttcacgtgtttccattgataataaacgattttattatcaacttgaagagcgatataatccgattgaatgtctgctaatctccctgtcttggactccgggcctccccggtagacagtaattacttttccttccatcgcatgcaaaaagttgtcatcagaccgatgccgcttcgtattgcgtttcatctattgtcctcctagtcatttttctcataatgtaaaaagcataatgcatatatacgtatcacgattattttcgggaactgattcaccagcctatttgtaaaaaatctttcttcatttccaaatcagatattccaccgctctaactcactgctgatgaaggcggaccgctccttaatgtattcgcaaatcacatcaggctcccggtcaaaccaatcaatctcctctttcttataaggatcctttgcgacatgcggcctgatctgctcatacagtgacatgaccttcggcttcatatgttcaatggtaaaccgggtctgaagcgtttcttccaaaagctgtttgtacgctttgcggaaatacggttcatccagaagccttgcagtcaaggtattaaacccttgtattctgacataatcggcgtccatccgatcaccgtgaatgtctcttccccacgtcgcatcgtaatcccacggaatgacttcaaaaagtcccgtttcatgattccggtacaaagcgtaattatgaacaaatccatcgtagtttgaggtaaacacgatgcccgcaagccaccgcaaatacttatcggcgtccaagtgtttgacgatctcccccttgaactctgacttcggaacggtattaattttatagatcatgtcctgcaagtataaatcgtcttctttcgttcccgttttcttttcataaccaagttcgagcgatgttttcgtatcccgctccagatcactgacaagggagaaattggcgtcgtcatcaaccgcgtaaaaaacagccccgtccgccaaattccgtttcgccagaaaatattcatccactgactccagctcaagatacaccccctcatgtctgccattgatttgcagggttacgaaattcgcctttggtgacagcgtcccaagctccgcgaagaaatcgagagacagcttattccgcatcatcgacggatctttgtattcagcgtttaaatgtatctctttcgccttgcgaaatgttttcggcgaataaaaagcgatgtgatacgattttttcttaaaatctcttatatgagagccgcggtacgccagatcaatgtcaagccgtttttgattcactctcagcaccgcgggcaccggatcatcatcccaaatgtcttttttcagctccattaagtctttcgggtgaataaacagctggtatagaggcaatgttgattggtctttcatcagtaaccctccctgtattaatttaggctgtgctatttatataaaactcagcgaatcacacatacacttttttcattcatgcgtactatgtggtagtaaggatcgcatccttaaaacatatatcatgaggaggtttcaaaatgggccactattcccattctgatatcgaagaagcagtaaagtccgcaagcaccgagggattggaagattatttgtaccaagaaccaaaaagcagtaagaagagaaaatctcgcagccataaaaaatcccgttctcac

SEQ ID NO: 112 - DNA, 132866 bp, Bacillus velezensis FL50S
gcgccgaaaaagtcgcggaaacgtataaaggcgacggtgcggccaacggcggcacggccggaacgggaagcaatgacaccgcgaactatgccgagacaaacggcggttcaaacagcggggactacgaaaaaagcagcaataaaatcaactatgaagtcaaccgcattcataaagaaatcgcggaaagcccgtataaagtgcgtgatttaggcattcaggtcatggtggagccgcctaatccgaaaaatgccgcttccttatcagcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatatattacaggcggcgtactgcttgcggccattattctgcttattattctccttatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaatagaaagattgactctcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagacaaagcggtaagcattttaaacaggctcacctcttctttgcaggtaaagccgtttgattttgcgagaaaagcggagcccgaacagattttaaattttattcagcaggaacatccgcaaacgatggcgctgattttatcctaccttgacccggtgcaggccggacagattttgtctgagctgaacccggacgttcaggctgaggtggcaagaaggattgcggttatggacagaacgtctcccgaaatcataaatgaagtggagcgggtccttgaacaaaagctgtcctcctcctttacgcaggattatacgcagaccggcggcatagaagccgttgttgaagtgttaaacggcgtagacagaggaacggaaaaaacgatccttgattcattagaaatccaagatcctgaattggcggatgaaatcaaaaaacggatgtttgtctttgaagatattgtcacccttgataaccgtgcgattcagcgcgtgatcagagatgttgaaaacgacgacctcctgctttcattgaaggttgcgagcgaggaagtcaaagagattgtcttcagcaatatgtcacagcgtatggttgaaacatttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaatcatcattttctcctgaacaaaaacggcgcaagctatccttgcaggaagtcaggaaaacacattcccagccagaccgggaggaacctgaaaatccggaggcgctcatggcctttgccaaggccgaagccgacagggtgtctgaagaagcgaaaagtcaattggatcacactcttcggcagattgaagaagagaaaaaccgctgggcggaagaaaaacaaagattgattgaagaagcgaaggcagaaggatataaagaaggcatggcattgggaaaagccgatgctcaagcagaatatgccaatctcatcagccgggccaatgccgttatggaaatggccagacaatcagtcgaggaaaaactggaaagcgctgaggaagaaattattgagctttccgttgcgctcgctaaaaaagtatggcggcaaaaaagtgacgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgttgatgcaggcatagacacccagctgatgcaattaaagcaaaagcttttaacggcgcttgaggcgggagcggagcaatgaagacacagtatttaatagactcaattgaaacagcggatccgtacaaacgctacggcaaggttaaacgggtcatcgggctgatgattgaatcaaaagggcccgaaagctcaatcggagatgtttgtctcatttatccgaaaggccatgcgaaaaaagcgattaaagctgaggttgtaggcttccaggatgaaaacattctgctaatgccttatctggaagcggccagcatagcgccgggcagcattgtggaggccactggcgagtcgctccgcatcaaagtaggggcgggtttaatcggacaagttgtcgacgcgttcggcgaacctcttgacggccgggcgcttccgaaaggtttgtcccccgtttcgacggaacagccgccgccaaacccgatgaaacgcccgccgatacgggaaaagatgggtgtcggcgtcagatcgattgacagtctgctgacggtaggaaaagggcagagaatcgggatttttgccggaagcggagtcggaaaaagcaccttgatgggaatgattgcgaagcagactgaagctgatttaaacattatcgcacttgtcggtgaacgggggcgcgaggtgcgtgaattcatcgagaaggatttaggcgaagaaggcctgaaacgctcgatagtcgtagtcgcgacctctgatcagcctgcgttaatgcgattgaaagcggcgtatacggccaccgccattgcggagtatttccgcgataaaggccggaatgtgatgttcatgatggactccgtcacgagggtcgcgatggctcagcgggaaatcggcctggcagcgggagaaccgccgacaacaaagggatatacaccttctgtgttcgctattttgccccgtttgctggaaagaacgggcgcaaatgaacaaggaacgataaccgctttttatacggttctcgttgacggagatgacatgaacgaaccgattgccgatacggtgcgcggaatattagacgggcatatcgttctcgatcgggcgcttgccaacaaaggacagttcccggccgtgaacatcctgaaaagcatcagcagggtcatgtctaatatttcagacacagcgcacatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaattggaagacagcattgcggcattgacgagtctgacaggaaaagaggaataaacatcatggcgtaccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcatcatgaaacgaaatgaaatgaatgagaagcaggaacagctcaccgaaaaaaacattgaagtaaagaaatttgaaaaaatgcgggaaaaacaatttaatatgttcgcacttgaagacaaagctgcagagatgagggaaatggacgacatttcaatcaagcagtttatgattcaggggcattaggagcgaatgaaatggccgataaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagatacaagcaagtccgaaatcgataatctgaatcagaaaatccgttcgctgaaacaggaagctgaacagcagcagaaaacgaagacggatgaaacgaaaaaagacgcttcggattcagccggaaaagataaaatgatcaacatctataaaagtatggacagcggtaaagcggcaagcattatcgtaaagctgaaagaaaaagaagccctcgatattttaaacggattaagtaaaaagcagcttgctgaaatcttgacgaaaatgactcctgaacaagcggctaaatatacagaaaaactaatcgctgacggaaataaggagtgatgtaagttgaagctgcttgaattaacgggtaatcgtacgcagactgcgcaaaacagcaatgtgaagatgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagcttaaacagctgcttgaggcggtaaaagctcttgaaggaaagcagacggctgaaacagctcttcctttattgaaacagcttgccgaatccgttgaagacatgttagcgggaaaacagcatggggcgaagcctgaaacgaatgagccggattcttccgcaaaagacggggattccgtcaaggatgcgcttgagaagggcctgcttttcattcaagaagccgtatcccagctcttcacatctcagcaggaactgccggacagcacgcaggcaaaggcggtttaccaggaaggcgcccgtttattagaggcattgaaaaaacaaggcgttccggaccgcgtgattcaagacctgcggcagacattttttccgaaaaacgaatctgcatctaaactttactccatgacagccgctgagctgaagagctttcaaagcgtcgcggagcagcttgcgggcctttctcaaaagggaacaaaggaatgggatatggctgaaactgagctgaaagcttttgtgttatctcaatcatctgaatcatcccaagagtcagccgggaaaacggaacagcaaaacggcggcacggtttctcacgcaaaggcgcctgacagcaaattgtctgcacatatactgttttcgggaacgagaagccttgccggcattcagcaagcgtccgcaggagctgaacagcagccggcagaaaataaaccgttaacggatcaggtcatcagcggctggaaacagatgaaatacacgcctttcgggaaaacaaccggaagctttacgattcgtcttaatcccgagaacctcggatttgtcacaattaaggtgacaaacgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaggcggggatcagcagcctgtttacgggcagacggccgatcacaataaacagcagcatcagggacagagagagcagaagaaccagcagcagtcaggcgatttcggagatatgctggaggagctttctctcaatgaaatggaggaagaatagttgacatcagtaaactcggattatgccgcggcgggcgcttcaaccacttcaaacgcgaagagcacctccgcagtaaacagcagtacgaatttagggaaagacgaatttctgaagatcttaatgacacaggttcaaaaccaggacccgctcaatccggttgatgacaaagaattcatcagccagatggcgacattttcttcattggaacaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataaaaagaaacccagggggaatttaacatgttacgttcattatattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcctgggtgccgcgacttcttccattgatgtcgttcattcaaccggcgccccgcaggctacacagaataaaaccgacctagccattgacggagacggctactttcagattaatacaggttcgggaatcgtttacacacgtgcggggaatttcggaaaggacaatcaaggcaaccttgttacgactgacgggtactaccttgaaaaaatcggcggcggcaaaatcaatattccgactgatgcgaaagattacagcatcggtgcagacggaaccgttacatacactgatgcaggggatgcggttcatgatgccggacaaatcggtctggtcacgttccctaacagcgccggtctggaaaaaatcggaggcaacctttacagagaatcattaagttcaggagctgcgagcgcagtcaccactccgggcgaaaacggaacgggtaagcttttggcaggctatcttgaaatgtcaaacgtagatctgacagatgaatttaccgaaatgatcgttgctcagcgcggtttccaatcaaactcaaaaatcattacgacttcagatgaaatccttcaggagctggttaatctgaaacggtaaggagggaggagaggcggttaggccgcttctccggattgcatgattcaagtcacccgtttaaacggccagccttttacgctgaacgcgctgtttatcgaacagattgagtgcttccccgacacgacgattacactgtccaacggcaaaaagttcgtagtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggacattccggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagctgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagttaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgaccaggtgccgtatgaagaatttatccgttccataccgaacatgacgattttaaatttattcgatgttcatccgatggaaggcagaatcatgatggaggttaatcccaccatcgcatacgcaatgcttgaccgcgtcatgggaggcatcggcatcactcataacaaagctgacagccttacggaaattgaaacgaatattatttctaacttatttgaaaatgcactgggcaactacaaagaagcttggcaatcgattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagctgcttgaaaagcgcatcatgacggctcaaattcccgttgtggctctcttgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcagtcagaggatacagaacagcctcaagaggcgaacttgtctgaacttgagcgcgatgcgatcggagaaatcgggaatatttcgttcggcagctcggctacggcgctgtccactcttttaaatcaaaaagtggacattacgacaccgagtgtgaccgtcatttcaaaaagcaaaatcagtgatgaatttcctcatccgtatgttgccattgaagtgaactacacagaaggctttgacggcagcaatttgctcgtcgtcgaacaaagcgacgcggccatcatcgcggatttgatgatcggcggagacggccggggcgccgatccgtcactcggtgaaatccacctgagcgccgtgcaggaagcaatgaatcaaatgatgggctcggctgctacgtcaatgtcgaccgtattcagtaaaaagattgacatttctccgccaagggttgaacttctggatgtgacggaagaaaaagggaccgacagaatacctgaggatgacctgctcgtaaaagtgtcattccgtctgaaagtcggcgaattaatcgattcgagcatcatgcagctttatccgattacgtttgcgaaagatctgatcgcagacctgatgactgcagaccagcatgagtcagaggccgcagaaaccgtatcagaaccacaggaaacatacgaaacgccgcagccggaacctgccatgcagccggagccgcaggcaaaacccgagcttccgaagagacagggaaccgcaaaaaaagctgctcctgttcaagtcgctccggtagaattccaggcgtttgatcataacgaagccgcacaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgttgacatcctggtcaaccagcggatcgtggcaaagggcgaggtcgttgtcatagaagaaaacttcggcgtgagagtcactgatattttaagtcaggcagaccgccttaacaatttaaaataagcgaacatagaggagagaaacagattatggcacacagaattttaattgtagacgatgcagcatttatgagaatgatgatcaaggatattttagtgaagaacggttttgacgttgtagctgaagcttcagacggagcgcaggcagtcgaaaaattcaaagagcattcccccgacctagtgacaatggatattacaatgcctgaaatggacgggattacagctctaaaggaaattaaacagatcgatccgcaggcgaaaatcatcatgtgttcggctatgggccagcagtcaatggttattgacgcgattcaggccggcgcaaaagactttatcgtgaaaccgttccaagcggaccgcgtgcttgaagccattaataaaacattaagctaaagggtgtacgactgttgaaaaagagtcatggtttactagctttgatttgttgtttcgttttactcaatgtacatccgttccctgcttttgcggcagagtctgataattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgatcggggcgttattattcgtcattctgctgatctatggatttgttaaactgatgaatagaagaaaccgtctgctgaagccgtttcaatatgtagaaaatatcggcggaacgtcagtcggccaaaatcgttccgtgcagctgattaaagtgggaaacagcgttctcgtagtcggtgtgggcgaaacgatacagcttttaaaagaaattgaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagctgaacgagctgaaacaaagccgttctgaaggaaagaagaaaggcccttatcatcatgaatgaattcgttaatctttttaattcaagcagtccgaccgaagtcagctccactgttaaattactgctgcttttgactgtcttttcagtagcgccggggattctgattttgatgacctgctttacgagaatcgtcatcgttctgtcttttgtgagaacctcactggcgacgcagaacatgcctccgaaccaggttttaatcggccttgcgctgttcttgacattttttattatggcgccgactttttcagagattaataaggaagccttaacgccgctgatggacaacaaaatcagtctcgatgaagcatatacaaaagccgagaagccgattaaagagtatatgagcaagcatacaaggcagaaggatctggcgctgtttatgaactatgccaaaatgaaaaaacctgaatcgattcaggatattcctttgacgacgatggtgcccgcttatgcgatatcagaactcaaaaccgcttttcaaatgggctttatgatttttattccgtttttaattatcgatatggtcgtggcgagcgtcttaatgtcaatgggaatgatgatgctaccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagcgggccgctgcttgcgatcgcgctgatcgtcggtttgctcgtcagtatctttcaagcgacaactcaaatccaggaacagacgcttgcgttcattccgaaaatcgtggcggtgatgcttggactgatctttttcggtccttggatgctgtcgacgattctttcgttcacaactgatctgttctctcatctgaaccgatttgcagggtagaatcaaatgaattccatcattgatttatttcccgcttttttattggtctttatcagaatctctgctttttttgtaacggtgccggtgttcggacatcggaatctgccggcggttcaccgaatcggctttgctttttttctttcggtgatctgcttcagcacgctgaaacatgcgccggaaatagaaataggggaacagtatatgctgcttgtcataaaagaggccgttgttggcttgagcctcgggctgattgctttcatgatgatgacagccattcagatagcgggttcctttattgattttcagatgggcttttccatcgccaatgtcattgatccgcaatcaggaacgcaaagcccgctgatcggacaattcgtttatacgctggcgctgttatttatgctcagcgtaaacgcccattatcttttattggacgggatttattacagctttcagtatatcccgcttgatcaggcatttccgtcgtttggaaatgatcactttggactttttatcgcaaaaagcttcaatgccatgttcattatcgcttttcaaatgtctgcgccggttgtggccagtctgtttttagttgatttggcgctcggtattgtggcgagaacggtgccgcagctgaatgttttcgttgtcgggcttcctctgaaaatagccgtgagctttattatgctgatcgtttgtatggcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgatatcattacatctgtcagcatcttccgtgcatgaactgttcgtagatacggtgaaagatatcagcctcatcctcgcgccgattatgctggtcgcgcttgtggcaggtgtcgtgagcaattacatgcaggtgggttttctgttttctgcggaagttctcaagcctgacttgaataagctcagcccgctgaaaggatttaagcggatttacagcatgagggcgattgttgaactggtcaaatccattttgaagattactgtggtgggttttgccgcctttatggtgctctggctgcattatggcgatattctccgccttccgcttttaacgcctgcggaagtgctcactttcgtttctaagctcacgctttggatggggcttgcgggatcaggggctctaatgctgctggccgggcttgattatttatatcagcgttttgactatgagaaaaatatcagaatgtcaaagcaggatataaaagatgaatacaaaaaatcggagggtgatccgattatcaagtccaaaattaagcagaagcagcgggaaatggcgatgaggcggatgatgcaggaagtgccgaaagcggatgtcatcattaccaacccgacccattatgcgattgctttaaaatatgatgaaaagaaaatggacgccccttacattgttgccaaaggggtcgaccatcttgcattaaaaatcaggcagatcgccaaagaacacgatgtcatgacgattgaaaacaggccgctcgcgcgtgcgttatatgatcaggttgacattgaccaggctgtgccggaagagttttttaaagtcattgcggaaattttggcttatgtatataaaacgaaacaaaaagtatagtgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggcttgcgctcaatgtgtcgacgacacgttcgattctttctcacggagaagggggaaaggttgttgagacattcgggaatttcgttgtcggcggaaatgtgctggtagggcttgttgtcttcattatcttaattattattcagtttatcgtcattacaaaaggcgccgagcgggtatcggaagtggcggcgagatttacgctcgatgcgatgcccggaaagcaaatgagtattgacgcggatttaaatgccggcatgattacggagcaggatgcaaagcacagacgtgaaaaagtcgcccgggaagcggatttttacggtgccatggacggtgcgagcaaattcgtcaaaggggatgccatcgcggggatcatcatcgtgatgatcaatattattttcggaatcgtaatcggcatgctgcagcaggggatgagcatacaagaagctgcgtctcactttacaatgctgacggtcggtgacggtatcgtttctcaaatgccggctttgctcatttcaacggctacggggattgtcgtgacgagagcggcatctgaaggaaacctcggtcatgatattacaggccagctgtttgcttatccgaagctcttgtatgtagccgcgggaactgtacttttgctcggtctgcttacaccgatcggcattctgctgacggggccgatcgccggtctgcttgcattcggcgcttatatgctgtccaaagcggataagccgagcgaagaagaggaagaaattcttgaagaagaggctcaggcggatgaactgaaaagcccggaaagcgttgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataacatcgcactccagccgaatgaatacagattgaaaattaaaggcaatgaagtcgctaaaggagagctcctgctggatcattatttagcgatgtcaccgacgcctgaagatgacgtcattgaaggaattgaaacgattgaaccgtcgttcggacttcccgcaaaatggatcagcgaagctgcaaaagatgaagcggacatgctggggtatacagttgttgatccggcgtcagtcgtatctacgcatattacagaaaaaattaagcagcatgctcatgaactggtcggcagacaggaaacaaagcagctgatcgatcatctgaaggaaaattatcctgtgcttgttgaggaagtcacgccgaaccctctttctgtcggcgatattcaaaaggtgcttgccaaattgctgagagaaaaagtttcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggttcagcagactgaacagggcaattacctgtcactcgaccctgaggtttcggacagcatcatccgttctgtcgctaaagaggccgagcagctttccatccgtcaggagtcggcgattcttctttgctcgcctgctgtcagaatgtatgtaaaacagctgttagaacggtatttccctgatcttccggttctttcttataatgagctggaagcaaatgttgaagtacagagcattggagtggtggatatttaatgaaaataaaaaaatttacagccgcttcaatgcaggatgccgcgaagcaaatcaaaaaggaactcggcaatgatgccgttattttacattccaaacaagtaaagaaacgaaaatggctggggctgcggtcgcagcaggccgtcgaagtgatagcggttttagatcgtgacgtcagggaagcgagaaaaacgccgccggctgccgctgaagaaatgaaaaagacggaaacggcggagaaagctgagcctgttcagccgccgcgccttccggatcaaagtatttccggcgaactggcgcatttgaaagaagtgctccctgaaccattaaaaaaagccgagagactattgaagcaagccgggcttcctgatcatacgcaaaacgccgcactcagtgaattgctcagttcttcaattgtttccggagatttaactgaagataatgtcagctcaaagctgcaggatttgttagtgaaaaaactcccttcgacagacaggtggcaggaagggattcaatcaaaatacgtcgtgcttttcggttcaaccggggccggcaaaacgactacacttgcgaaacttgcggcctcatcaatgctgacagagcataaaaaaattgcctttatgacgacggatacttaccggattgccgcggtcgagcagctgaagacatatgcggagctgcttcaggctcctcttgaagtatgctattcaaaggaagaatgtctgaaggcactggaaaaattcgctgaatacgaccatgttttcattgatacagccggcagaaactttaaagaagagcagtatattacggaattacaagagatgattccgtttgaatcaggcttacaatcctttctcgtattatcggcatctgcaaaatatgaagatatgaaacaggtgctgaaacagttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaagacatcctatcggcttcaccaaaagagtttgtaaggatgcttttggcatgaaacccgatcaggcagagtcattaagaaggaaaatgagagagaggcaaatgatcaagccggagctttatgagaaaaaagcgaagacattagccgtcataagcggtaaaggcggcgtcggaaaatctaatttaacattaaacatggcagttgccctgcaggaaaaaggaaaaaaagcactcatcattgatcttgacatcggaatggggaacattgatgtgctgatcggagctgcttcttcccgcaccattattgatgtgatggagaatcggcacgcgttggctcaatcactttcctccggtccgaaaggccttcgctacatatccggaggaacggggcttgaggcgttctatcaagcagacagagagaagtggtcggcttttatgaatggtctttccgctgtattaagcgattttgattacgttctgtttgatatgggagcgggactttcaaaagaacagctgccgtttattttatcggcggaagacattctcgccgtgacaacgcctgagccgacggccattatggatgcgtacagcgcgatcaaacatcttttgctcgcggatgaacggctgaccgtaaacattgccgtcaatcgcgcccgcgcccaaaaacaggcgctggacacgtacaaccgcctttctcatgcgatccacacgtttttaggcgcggaggtgcgtttcgccggctccatacccgatgatccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtcatcatggtatcgagccagacacagcaagggaaggaccgaacgatcaactgcctggagatgggcgcttttgattttatcactaagccttccggagcgatttcacttgatctttataaaattaaagagcagctgattgagagggtgattgcagccgggatgtcccgcgcacaaaaacctgaggcggcagtgaaagagtcttctatcccggaacgtccggctttggcgggatttgaaagaccgaaagcaaaatccgccaagcaggccgtattcatcgcgacctctacaggcggaccgcgggctctgcaaaaggtggttccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgatgttcatgatacggaaagccggcataaaccgtcagccgattatttgtttcggtcggcaagccgtttatccggttacgaaaaggtagccgtcattatgacaggcatgggcagcgacggaaccgagggcgtaaaagaaatgctcagaacaggcggcgttaaaacgattgcggaatcggacgaatcctgtgttgtgttcggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggacgtgctgtttgaagcgcttgatcatcttgaagagatggtgcagtccattattgacggaggagacggcaaacgtgatatttctgaagtgagtgcgaagctcgacgtaaatgcggtgcatgagactgcggcttcagccgaaacagcagaaccgccggcttcaaaacaacagacttcaactgaatggaattatgatgagttcgaacggactgttattgaagaggcggaagagcaaggattcagccgctatgaaataacggtttccctgaatgaaagctgcatgctcaaagccgtgcgcgtgtacatgatatttgaaaagctgaatgaagccggggaagtcgcaaaaacgatacctgccgcggaagtgcttgagacggaagatttcggaacggattttcaggtgtgtttcttgacaaagcagcctgctgaggaaattaaagaactcatcagcggcatttcagaagtggagaatgtcgaaatttctgccggtgcgccgttaaaaacggccgaaaaaccgcaagcagctgaaccggtgaaggaaactccggttaaaaaggctgaaaaacagccgaaaccgcaagcgaaaacggaagagcagccgaagcatcacagcggctcgaaaacgattcgcgtcaacattgaaagactggattcttcaatgaacctttttgaagaacttgtcattgaccgcggacgtcttgagcagatcgccaaagagcttgaccacaatgagctgactgaaaccgttgaacgcctgaccagaatttcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgcacggtgattgatgaaatcggcgatccgcttgtccatttaatcagaaacagcatcgatcacggcattgaatcgcctgaagtgcgggtgaataaaggaaaaccggaatcgggtcatgtcgtgcttaaggcatatcacagcggcaatcatgtctttattgaggttgaagatgacggggccggcctgaacagaaagaaaattcttgaaaaagcgctcgagcggagtgtaattaccgaacgtgatgctgaaacgcttgaagataatgagatttacgagcttatttttgctcctggcttctcgactgccgatcaaatttctgacatttcaggtcggggtgtcggtctggatgtcgtaaaaaataaactcgaatcactcggcggctctgtcagtgtcaaatccgcggaaggccaaggttctcttttcagtatccagcttccgctgacactttcaattatatccgttcttctcattaaactggaagaagagacgtttgcgataccgatttcttctattatagagacggctgttattgataagaaagatatcctgcagacgcatgacagagaagtgattgatttcagaggccaaatcgttccgatcgtctatctcaaaaaagaattcggcattacagattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgcaatgcgctgatctactaaaacgacacgaggaggtgcccgcatgactgctgaaatcaaaacaggtgaaaaaatgattgtgtttatgataaacgggaaagaatacgctatctcagtttcccaggtgaaatcaattgaaaagtggcaaaaaccgacgagggtcccgggtgtggaatcgtatatccgcggcgttatcaatctgcgcggagtaattaccccggttcttgatttaagaaaacgtctgaaccagcctgaacaggacatcacagaagagacacggattatcatcatttcttaccgtgacgccgatgtcggatgggtcgtggatgaggccaatgacgtcatcaccgtgcatgaaaatgaaatcgaatccgcgcctgaaagccagacaaaggaaacggatgtgtggattaaacagatcgtcaagcaagataacaggctcctcaatattattgatgcgcatgcggtgctggataaaggtgcttcggcatctgcgtccggagagccgaatgcttaaaggggaaaagacaacatgagtaagtttgaagcgatcaaagaagagcagatggatattttgcgggaagtcggaaatatcggggcgggtcactcggcttctgccatggctcagctgctgaacagaaagatagacatggaagtgccgtttgcgactttattgacatttgatgagctcgctgattttttcggcggggctgaaacgccggtcgccagtatctttttaagaatggaaggcgacatgacaggctctatctttctcatcatgcctttccatcaggcggaacagtttatcagagagctgatcggaaatccggattttgatattgaccagttgggcgaagatcatttgagttcttctgctttacatgagttcggcaatattttagcaggttcctatttaacggcattggctgatttgacaaagcttgagatttacccgagcgtgccggaaatctcacttgatatgttcggcgcggttatcagtgaaggactgatggagctcagccaagtcggagagcatgccattgtcgtggatacttctatttttgaccagggcagccggcaggagctcaaagcccatatgtttatgctcccggactatgattcttttgaaaagctcttcgtctcattgggtgcggctttatgagccgtgcggaagccgcagtcgttaaagtggggattgcggatgttcaagtcgcgcgttatccggataaaatccggacttcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacgattgatatgcttttgaaagccggctgccgcaagtttgccctgaaggcaaaactcgccgggggagcggagatgtttaagtttaaaatgacaaacgacctgatgaaaatcggtccgaggaatgtagcggctattaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgccgctggtcacatatcatgtcggcagaatttccgtcggactgccgaaatcggtgcataaagacgatctaatgagccttggtatgcttggtttatatgatgccctagaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcaatcgaaaaacttgaacagcgctaccttcggaatgtgacgccttcagagatcgcagaagagcttgggatgacggagcaggacgtagtatcaacgatgaatgaaggtttttttgccaatctcttatcaattgatgaaaagcttcacgaccaggatgacggtgagaatattcaagtgatgatcagagatgacaaaaatgtgccgccggaagaaaaaatcatgaaggacgagctgatcgctcagcttgcgggcaaaattcacgagctctctgaaaaagagcagcttgtcgtcagtttattctataaagaagaactgactttgaccgaaatcgggcaagtcctgaacctttcgacgtcgcggatttcacagattcattcaaaggcgctgtttaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacacccttgcagcgtttctgcttgagctgaaagaagaaaatgaaagactcgaagacacaaaaagccggaatgatcaagcgcctgacgcagaagacgccgaaccccggccggaaccgaaaaaagagcctgatattccggatcacatggaaaagctcatcagtgcaacggaacgggctgaaagtgacgaaaacaacggtgcgcattcgtttgaagaacgtgtttcagaattatatgaacaagggctcacccctgcggaaatcgccaaacgggtgcagagcggaaagacagaaatcgagctgtttttaaaatttcgcggcaaagctgtaaaggattcttgattgtcgcataaagctgtgttatattatgtcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgccattcttgaagcgaagcaaggcgaagaagaagcggaagctgctgaagagactgcacctgaaacagaaacgacaactgcgtaacctaatcaaaaggtgataagagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcgatgggtcaaaagatggaaaacggttctactgttgaagaatacatcacaagcaacgttgctaaaatcggagagaaaatcactcttcgccgttttgctgttcttacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttatatttcccgcgaccaagtgtctgaagaagaagcaaaccatgagcgtcagatcctgactcagcaagctcttcaagaaggcaaaccggaaaatatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggcattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaacggcattaatccgactgttatccaatccatcgctaaacaggtaaaagaaatcgctgagcttgacgtcgaagtggccgtagttgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaatccagtccagagtgcagacatcaattgaaatgcgtcaggtcgctgagccttatatcagaagaaaagccatccgccacctggagaaaaaacgcgttgtgatttttgccgcgggaacgggaaacccttatttctctacggacacaaccgcagcgctgcgtgccgctgaaatcgaagcggatgtgattttaatggcgaaaaataatgtcgacggtgtgtataatgccgatccgagaaaagatgagtcagctgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaatcggcgaatcaatcggaacgatcgtaagggggaaataacgttgtcaaacgaagtattaacacaaacaaaagaacgcatggaaaaagcggttgccgcttattcacgtgaattggcgtcagtccgcgcgggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgaccttggcgtaactccgacaagtgacggcacaattattcgcatcgcgatcccggctctgacggaagaaagacgtaaagaacttgtcaaagtcgtgaagaaatacgcggaagaagcgaaagtagcagtccgtaatgtccgccgtgacagcaacgacgacctcaaaaaacttgagaaaaacggggacattacagaagacgagcttcgtgcttccagtgaagacgttcaaaagctgacagatgaatatgtgtcaaaaattgacagcgtcacgaaagacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactcccgcggattgccggacatcatgaaggaatgaaagtggtaaaaagggtgacaaagctcgcaaatcagctcggcgttaaagttctgactctttatgcgttttcaacggagaattggaagcgaccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaggccgtaaaagatacagaacaaaatgacgggctgattctcaatttcgctttgaactacggcggacgcacggaaatcgtcaatgcggcaaaagcattggccgaacaggtgaaaagcggcacgctgaatatcgaagacattgatgaagcgctcttttccgggcatttaatgacaaaatcaatccaggacccggagctgctcatcagaacgagcggagaaatcagactgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagattgttaacaggtgttctggcagcggcactatttttatttttggttattttcggaggattgccgttcaccgtatttgtttacgtgatgggaagtatagcgctttttgagcttttgcggatgaaaaagctcagatttttttcttttccgggtctgatcagcttcttgttgttatggctgtatatgatgccggacaaatatcattttttcgatgcgaaaatggaagtaacgattttcgccgtattgattctgctcagctatacggtgctcgtgaaaaacacctttacgtttgacgaagtcgggtttatcgttctcgcgacggtatatatcggactgtgttttcattattttattgaaatcagaaacattgaaacaaacgggcttttgtatatcttttatgcctgcgttgtcatatggtcaacggactcaggcgcatatttcgtcggaaagtcgctcgggaagcggaagctgtggcccgaaatcagtcccaacaaaacagtggaagggtttctcggcggtatagtcatcgcccttatttttacggctgtttttcagctgtttgcacaccttccgatttcatatccggttcttttggtcatcacgcttgttctgtctgtgttcggacagatcggggatttggttgaatcagcgcttaagcggcactatgatgtgaaggattcggggaaaatccttcccgggcacggcggcattttagaccgatttgacagctttttgtttgtcatgccgttcttatactttctgcttgcgcttttttcatgagaaaggctaatatgaaaataagaccgatctggacgcatagaatgggagtggcattttgaagaatatttgtcttttaggagcaacaggatcaatcggggagcagacgttagacgtattgcgcatgcatcaagatcagttccgtctcgtctcgatgactttcggtaaaaacgccgagaaagcgatcccgttgatcagaacgtttcagccgaaatatgtagcagtcggcgacatggatacatatcaaaaagtgaaagaagcgtctttttcgcatgaatgtcaaatcggcatcggagaagaaggcctgattgaagcggcagtcatggacgaagtggatatagtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggttgacagcgaacattccgctatttttcaggcgctgcaaggcgaacagagcaaaaatatcgagcgcctgatcattacggcatccggcggcagtttcagggataaaacgcggcaggagcttgagtctgtaacgattgccgacgcccttaatcacccgaactggtcgatgggtgcaaagattacgattgactcggctacaatgatgaataaagggcttgaagtcattgaagcgcattggctgtttgacattccgtatgaacagattgacgttgtattacataaagagagcatcattcattcgatggttgaatttcacgacagaagcgtcatcgcccagctcggaaatccggacatgagggtgccgattcaatacgcgctgacatatccggaccggctgcctctgcctgaaacaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcattggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagaggacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgattatgaacttcatcttagcgtatgtcattctcgtcatgctcggattcattcaaggcgtgccttcaaatcagcctgaactcgggaagctgacagacaatggacgcgcagctgctgcaggtttaaaagaaggcgactatatccagagcattaacggtgaaaaaatgaggtcatggaccgacatcgtgacagcggtaaaagaaaatcccgggaaaaaaatcgatgtcgccgtcaaacgggatggcaaatcgtttcatatctcggttacacctgaagctgtaaaagatgaaaataaaaaaacaatcggccgcttcggctcttatgcgccgactgaaaaaggcgcgcttgcagcgattgcttacggcgcgacatctaccgttgatgtcacaaaagcgatcctgaccaatctgagcaaacttgtgacaggccagtttaagcttgatatgctttcgggtcctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcatagaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgtgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcgggcgcgatgggcggaaaagacacgcatgaatttatggctctttctgaaataggggaagataccatcgcttattccgatggatcctcttacgcagccaatacggaaatggcggaagttgtcatgaacagcgagccgtcagatgaaacacccgaggcattggagaaaattgatacgccgaatgtcaaaagcattgaagagctcgcttcgttcttgcagatcgagccgagcgcctgcatcaaatcaatgctgtttaaagcggatgaccgatttgttctcgtgttagtaagaggcgatcatgaggtcaacgacgtgaaagtgaaaaaccttctgaacgcggaagtggttgagcttgcgtctcatgaagaagtagcggagaaacttggcacggagccgggatttgcggggccgatcggcgctgccggcgacattgagatttatgccgaccaagccgtgaaagtaatggtaaacgccgtttgcggcgcgaatgaaaaagaccgtcattaccgaaacgtaaacatcgaacgtgacgcgtctgtaaaagcgtatgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttcagccatcgctgaacagcatcacgacgaaaaaggcttgatctggccgaaaagcgttgctccgtatgatcttcatattttggcgctgaatatgaaaaacgaagcgcaaaaagagcttgctgaacagctttacggcaaattccaggcggaaggttatgaggtattatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgccgaagtttcagtgaatgagctttctgaatttattaagacgaagtaatcaccataacgaatcgtacaaaatcatgttaaaatagagaaaaaagaaggtacctcatcacctgcggaggtaccttcacttatgatgttttaagggagggatactgtctgaatggaacagttatcagttaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatatgattcattcatgatgaggttaacacaatcgtttgctcacatcgcccgtgtcacatcgtctgttcaggtcatcgatcctacagtgacagaggagcttgtacaggattattggacacgctgtattgaagagcttgaaggaacctcgccgccgatggtggctcttttgaatcagcagaagccgaagctcaagggaaacaaactgatcgtgaaaacaaaaacagatacagaagcatcggcgctcaaaaataaatacagcgcactgattcagcacagctatcgccaattcggatttccggaactgcagctggataccgaaattttcgtatctgaccaagaagtccagaaattccgcgagcaaaagcttgctgaagatcaggagcgggcgatgcaggcgcttatcgaaatggagaagaaggaaaaagagggcgatgaggatcaagcgccgtccggcccgcttgtcattggctatcaaattaaagagaacgaagaaatccggacgcttgacagcatcatggatgaagaaagaagaatcacggtgcaggggtttgtgtttgatgctgaaacacgcgagctgaaaagcggacgcacgctctgtattttcaaaatcacggactatacaaacagtattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcatgccgttgtgcagtctttcccggatgcctattccgccgcgaaaaaacacggcattaaaatgatttacggaatggaagccaatatcgtggatgacggtgttccgatcgcatacaatccagctcaccgtcttttggaagaagacacatacgtcgtctttgacgttgaaacgacaggtctgtccgcagtgtatgacaccatcattgagcttgccgcagtcaaaataagaggcggagaaatcatcgataaattcgaagcgttcgccaatccgcaccatccgctgtcagcaacgacgatagagcttaccgggataacggacgacatggtccgcgacgctcccgatgtcgttgacgtcgtccgggattttaaagaatggatcggcgatgacgtgcttgtggctcataacgccagctttgatatgggatttttaaatgtggcgtacaagcgtcttttgaaaacggaaaaagcgaaaaatccagtcattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaaggccttatcacgctacattgcttgccgtaaatgagaccggccttaaaaatctgtttaagctcgtgtccatttctcatattcaatatttctacagagtgccgcgcattccgaggtcgcagcttaataaatacagagaaggtctgttaatcggctctgcctgtgacaggggagaggtctttgaaggcatgatgcaaaaatcacctgaagaggttgaagatatcgcatcattctatgattatcttgaagtgcagccgccggaagtatacagacaccttctgcagcttgagctcgtccgggatgaaaaagcgctgaaagaaatcatcgccaacatcacgaagctcggggaaaaattgaataagccggtcgttgccaccggaaatgttcactatttaaacgatgaggacaaaatttaccggaagatcttaatatcttcccaaggcggcgccaacccgttaaacaggcacgaactgcctaaagtgcacttcagaacgacagatgaaatgctggatgctttctcctttctcggtgcggaaaaagcgaaagaaattgtggttgacaatacgcagaaagtcgcttcgatgatcaatgagatcaaaccgatcaaagacgatctgtacacgccgaaaattgacggagccgatgaagaaatccgtgaaatgagctatcagcgcgccagaagcatttacggtgaagagcttcctgaaattgtggaagcgagaatagaaaaagaattaaaaagcatcatcggtcatggattcgccgttatttatctcatctcccataagcttgtaaaacggtctctggatgacggttatctcgtcggctcccgggggtccgtcggttcatcgcttgtggcgaccttaacggaaattactgaagtgaatccgctcgctccgcactatgtgtgcccgagctgccgatattccgaattctttaatgacggatcagtcggttccggttttgaccttccggataaaagctgcccgtcttgcggcacacctttgaaaaaggacgggcatgatatcccgtttgaaacgttcttaggctttaaaggtgacaaagtacccgatatcgacttgaacttctcaggtgagtatcagccccatgcccataactacacgaaagtgctgttcggtgaagataacgtgtatcgcgcgggaacgatcggcaccgttgcggaaaagacggcttacggatatgtgaaaggctatgcgggtgatcacaacctacacatgcgcggcgcggagatcgaccgtctggtgcagggctgcaccggcgttaagagaacgaccggccagcacccgggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgacccgacagtcatccggatgctccaggatttaagcggaattgatccgaagacgattccgacagatgatccggaagttatgaagattttccaaggtacagaatcgctcggcgtcactgaagagcagatcggctgtaaaacggggacgctcggtattcctgaattcgggacgcgatttgtgcggcagatgcttgaggatacgaagccgacgacgttctccgagcttgtccagatttccgggctttcccacggcacggacgtatggctcggcaacgcgcaggaactgatacacaacaatacgtgtgaactgagcgaagtgatcggctgccgtgatgacattatggtttacttgatttatcagggccttgagccttcactggcctttaaaatcatggaattcgtgcgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtgctgatggcggtgcggattgcctattttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgcctaaggagaaaaacctccttaccgtgttagagcttgcgcttgaaatgtgtgagcgcggctattccttccagaaggtcgatctataccgttcgagcgcttcggaatttatcattgacggcaacagtctcatcccgccgttcaactcaattccgggactcggaaccaacgccgctctcaatattgtgaaagcgcgggaagaaggggagttcctttcaaaagaggaccttcaaaaacgaggaaaagtgtcaaaaaccattttagagtatttagatcgtcacggctgtcttgagtcgcttccggaccaaaatcagctgtcgctgttttaagctttgtgcacagcctccgagcggagtttgatttgcattaaatatatggttatggtatagttttattggaaatgctaacgattaccgaggcaaagagtggggaaacccgctcttttgtattgaacaggcaattttgcctcgacatgtccatcgttttctcaatgcccctgctctttagaagcagggtttttatgcagaggaacggctgatatgatatcgacagcacaaggaggaaaaacatgagcaaaaaagtgactgataccgttcaaggaatggctcagcccatactggatgaccttcagcttgaactcgtagacattgaatttgtcaaagagggtcaaaactggttccttcgcgtgtttattgattccgataacggtgttgatattgaggagtgcgccaaagtcagcgaagcgttaagcgaaaagctggatgaggccgatccgatcactcagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcaagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgatccgcgtgttcgcaagaaaggatgtcgtagacgaggtatacgattcaagacttgaaatctcgcttgacgacgcccagcacatccatccgaactaccttgtcggagatgtcgttgaaatagaagtcacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggcctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgtcggtcctaaaggccagcgggtgcaggcgatcgtcaatgaactgaaaggcgaaaaaattgatatcgtcaactggtctgatgatccggttgaatttgttgccaatgcgctcagtccgtctaaagtgctggatgtcatcgtcagcgaagaagaaaaagccacgactgtcatcgttcctgattaccagctttctctggcaatcggaaaaagagggcaaaacgcccgcttagccgcgaaactgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaataacaacaaaaacaaaaacaaacgcaatcataacaacaaaaatcagtatcagcaaaaaccgctgaagccgaaaaaagagcttcctgagaaaattacgttttccggctctttaacagtcggggccttagccgaagaacttggcaaagaaccgtctgaactcattaaaaaactgatgcttctgggtgtaatggctaccattaaccaggagcttgacaaagacacaatcgaactgatcgcatctgaatacggtgtggaaacagaagaagtgattgtgctcgaagaaactgagcttgaaaaatatgaagaggctgacaaagaagaagatcttcaaatccgtccgcctgtcgtgacgatcatgggccacgttgaccacgggaaaacgaccctccttgacagcatcagaaaaacaaaggttgttgaaggtgaagccggcggaatcacccagcatatcggggcgtaccagatcgaagaaaacggcaaaaaaatcacgttcttagatactccgggacacgcggcgttcacaacaatgcgtgcgcgcggtgcggaagtaactgatattaccattttagtcgtagcggctgatgacggcgttatgccgcaaacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtctgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcaacacttctcgttcaaacgggaacattgcatgtcggagatccgatcgttgtcggaaatacattcggccgcgtgcgggccatggtcaatgatctcggccgccgcgtgaaaacagccggaccgtccacacctgtagaaatcacgggcttaaacgacgtaccgcaggctggcgatcaattcctcgtctttaaagatgaaaaaacagcccgttctgtcggtgaagcacgcgcttccaagcaactggaagaacagcgcagcgacaaagcgaagctgagcctcgatgatctgtttgaacaaattaaacaaggcgatgttaaagacatcaatttaatcgtaaaagctgacgttcaaggttcagccgaggcgttaacagccgctcttcaaaaaattgaagtagaaggcgtaaaagtgaaaatcattcacacaggcgtcggtgcgattacggaatcagacatcattctcgcatctgcttcaaatgcaattgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgagtacgaagaaaaagtcatcggtcaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttctgaaacgcttcaaagatgatgtgaaagaagtttcacaaggatatgaatgtggtataacgattaagaaatacaatgacattcgcgaaggcgacgtccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgctgtcgtctcttcctctcacgttcaggcggaaaaggagatccagcgcgtactcgcgtttattgactcctttcccgagatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttacaaatagcgaaggtgtatatctccgttctcggcggagagaaaaagaaagaggaggcgctgaaagggcttgagaaagcgaaaggatttatccgttccgaaatcggcagccgaatcagactccgcaaaacgcctgagcttgaatttgaatttgatgaatcaattgagtacggcaatcgtattgaaacattgattcacgaactgcattcagataaaccgtctgaataacgggaaagaggatgggcgagtgtcgtctgtcctcttttctgcgttttacgggatacaattgataacaaaggagcgaaagacagatggttaacggagttctccttttacataaaccggtcggcatgacttctcacgactgtgtaatgaaaataagaaaactgttaaaaacaaagaaagtcgggcatacgggaacccttgatccggaagtgtcaggcgtactgccgatctgtgtcggacgggctacaaagatcgttgagtacgtcaccgacaagtcaaaaacgtacgatgctgagatcactctcggtttctccacatcgaccgaagatcagacgggagaaacggtcagcgtaaagcctgtcagggagccgctgaaagaagcggatatcaaagccgttttagacgaattgaagggaccgcaggagcaagtgccgccgatgtattccgcggtaaaggtcaacgggaaaaagctctatgaatacgccagagcgggtattgaagtggagcggccgaagcggaatatcacgattgaagatatcgcgctcacttcccctgtcacttataacgaagacacagcatcattccgctttacagtcacgtgctcaaaaggcacttacgtcagaacgttggcggtgacaatcggtgaaaaactcggctatcccgcgcatatgtcgcatctcatccgcactgcttcgggcgatttcagccttgatgaatgtttcacgtttgaggaacttgaacagcaggtttcggacggaacggttgcagagcatgccgtgccgatcgatagagcgctcaatcatttgccgaaatgggtcataagtgatacattagctaagaaagctgaaaacgggtcagtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccccacccttcccatgtgttgggcagggacaaagagccaaaggatctgattacgccgcttgaagataaaatcagccagatcggacgtttaggcgctgatgtgctgtatgtcgtaaagtttgatgaagcgtttgcgtctctgtctccaaaacagtttgccgaggagtatattttagggttgaacgcgcggcacgctgtgggaggcttcgattttacgtacggaaaatacggaaaaggcacgatggagacgctgccggacgatttaaacggcaaggccggatgcacgactgtcgagaaacagaccgagcaggacagaaagatcagctccacttatatccggtcagcgctccaggatggtgacgttgaacttgcgcacactcttctcggtcagccgtattttatccggggcactgtgattcacggagacaagagaggccgcaccatcggttttccgaccgcgaatatcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcgattgaagttcatttgtttaattttcaacaggatgtatacggagaagacgttaaaatcgagtggtacaaacgaatccgaagcgaacggaagtttaacggcatcgatgaactgacggctcagatcgggaaagacaaacaagaagcgatccgttttttcagcaaataacggaaaaaacatcaaaagtacacaaattttattctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagcgagttcaaaacacacgaatctgatactggttctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataataataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgacgggaaattcgtcatcaatccgacggttgaccagcttgaaaaaagtgatatcaacctcatcgttgcaggcacaaaagatgccatcaacatggtggaagccggagcggatgaagttcctgaagaaatcatgcttgaggcgattatgttcggtcacgaagaaattaagcgcctgatcgcattccaagaagaaatcgtcgcagcagtcggcaaagagaaaacagagatcgaactgtatgaaattgacgaagagctcagcgcaaaagtaaaaagccttgcggagccggatcttctcagcgccattcaggttcacgaaaaacatgctcgcgaagacgcgatcaatgaagtgaaaaatgcagttgtcgcgaaattcgaagaagaagagcatgatgaagatacaattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggccttctgccgagaacgcacggatccgggctgtttacgagaggacagacgcaggcgctcagcgtttgtacattaggcgcccttggagacgttcagattcttgacggtttaggcgtggaagagtcaaaacgctttatgcatcattataacttcccgcagttcagcgtaggggagacaggcccgatgcgcggaccgggacgccgtgagatcggtcacggtgctcttggagagcgtgcgcttgagccggtcattccgaatgaaaaagacttcccgtatacggtccgcctcgtatctgaagtgcttgaatcaaacggttccacttcacaggccagcatctgcgcaagtacgcttgccatgatggacgcaggtgttccgattaaagcccctgttgcaggtatcgcgatgggacttgtgaaatcaggcgagtactatacagtattgacggatattcaagggatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttggacagcatgctcagcacgcttggtgaatcaagaaaagaactttctcaatatgcgccgaaaattttaacgatgaccattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccagctttacctcggtaaagtgaaacggattgagaaatttggcgctttcgttgaaatcttcagcggaaaagacggtctcgttcacatctctgaactagcgctcgaacgggtcggcaaggttgaggatgttgtgaaaatcggtgacgaaatccttgtgaaggtaactgaaattgacaaacagggacgagtgaatctgtcgcgtaaagcagtgctgcgcgaagagaaagaaaaagaacaggaacaacaacaatcataaatgaaaacctaacaaggagcctgggagacccggcttctttattttgagaaagacaacagacgggttctaccttgtcctcctcatacataatgtgtgatgaggggggaaggacatgttgaaaaaattcgtgccgtttgccgtttttttatttcttttttttgtttcgtttgaaatgttaaaaaacccgtatacagttgattacatagacgcaatgaaaaaagacgcggtaactgtgtcagcatcaaaagatccgctctatgaagaattactgcaaaaagcgtcagagtatgaagtgaagccgcaagacgctcggattgataaaatatggaagagtataccgggatataacggtttaaaagtcaatgtggaaaaatcctataaacaaatgaaaaaggacggagaatttcacgaagacgaccttgtctatgagcaggtaaagccgaaagtccatcttgattctctcgcgcccgaacccatttataaaggaaatcccgacaaaccgatggtcgctttcctgataaatgtcgcctggggaaatgaatacgtggagcaaatgctgcctattctgaagcagcaccaggtcaaagcaactttctttcttgaagggaaatggctgaaaaacaatcaggaactggggaaaaaaatagcggcagacggacatgaaatcggaaatcattcatacaatcaccctgatatgagcaaactgacttcaggaagcatttccgaacagcttgacaaaaccaatgcacaaatcagcgagacgctcggcatgaagccgaaatggtttgcgccgccaagcggcagcttcagaaaagccgtggtcgaccttgcggcggaaaaaggaatgggcaccatcatgtggaccgttgacaccattgactggcaaaaaccgtctcccgctgttttacaaacaagggtcttgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcagttgcctgtctttgaataggaggaacagacttgataaaacgctatacatgccaaaacggtgtaagagttgtgcttgaaaataatccaacggtgcggtctgtggcaatcggcgtatggatcgggacgggatcacgtcatgaaacgccggagacaaacggtatttcgcactttcttgagcatatgttttttaaaggaacaaataccaggtccgcacgtgaaatcgcagaatccttcgatcggataggcggccaagtgaatgccttcacttcaaaagaatatacgtgctattacgccaaagtgctggatgagcatgcaaactacgcacttgatgtgctggctgatatgttctttcattctgcttttgacgaagatgagctcaaaaaagaaaagaacgtcgtatatgaagaaatcaaaatgtatgaagacgcaccggatgacattgtccacgatctgctgagcaaagcgacatacggcaatcattcgctcggatacccgattctcgggacggaggaaacgctttcgtcgtttaacggcgattctctcagacagcatatggatgacttttacacgccggaccgcgtcgtcatttctgtcgccggaaatgtaacggaacaattcattaaagacgtggagaaatggttcggtacatacgaagcgaagggcaaagcaagcggcatcagcgagcctgagtttcattatgaaaagctgacgagaaaaaaagacaccgaacaggcgcatctctgtctcggtttcaaaggcctgaaagtcggagatccggacatttacgatttgatcgtcttaaacaacgtgcttggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagaaagcacaaacagcaaaatgagccggaacgggaaaaatgaactcctgctcggaaagcataagaccatggatgaaattatcgctgaattaaatgcggtcagcctggaaagcgtcaacggcctcagccgccgcttatttacggatgattacgcactatcgctcatcagcccgaccggcaatataccggcctcgtcttaagctgcaaagcagtctgcctctgtacggggcaggcatttttttttgctccgggtcatatagtacaagggggtggctatcatgaggctcagtgaactgtcaggtaaagaaattgtggatattaaacgggcagagcggctcggcgtgctcggccagaccgatttggaaattaatgaacaggacggacaaattaccgcgctgttgataccgacggtaaaatggttcggactgcgaaaacaaggccacgacatccgcgtcccctggaaccatatccaaaaaatcgggtcagacatgatcattttagacgttccgggggagatcacgcctcccgaagagtagatcttattcattttttgcaagcaccggctcatacagccggtgctttttttatgaaaaagacgctgtacattcaccgccctttctctttgcacatacgatgaagaggaggatgacacttaaaggatccagtaactgtaaagaaggtgaacgtttcagatgttaaccggattaacaattgcgatcattggcggtgacgcaagacagcttgagattataagaaagctgacagaacagcatgccgatatttatcttgcagggtttgaccaattggatgacggttttacaggaaccgtcaaatgcaaaattgatgagattccctttcaaaaaatagacagtatcatcctgcctgtatcggcaacgaccggagaaggcgttgtttccacggttttttcaaatgaagaagtggtattaaagcagagctatcttgagcggacaccggagcattgcgtcatttattcaggcatctccaacgcgtatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgtcgccgttctcggcatggggcgcaccggtatgacgatcgcccggacgtttgcagcgttaggggcgaaagtaaaagtgggcgcgcggagttcggctcatttagcccgtatatcggaaatggggctttctccttttcaacttgaagagcttactgatcatgtaaatgatattgatatctgcattaacaccgtaccgagcttgattctgaatcaaagcgttttatcgcgcatgacgcccaagaccttgattttggatttagcatcccgtccgggcggaacggatttcaaatatgctgaaaaacaaggcattaaagcgctgcttgctccgggtcttccgggaattgtggccccgaaaacagccggacagattattgcgaacgtattgagcaagcttttggcagacttaaagaaagaggggaaataaccatgtctctgaaagggaaaagaatcggattcggattaaccggctcgcattgcacatatgaggaagtgtttccgcaaatagaggcgcttatcagtcaaggagctgaagtccggccggtcgtgacatcaaccgttcaatcgaccgatacccgctttggggaggggggagattgggtcagaaaaattgaagaaacaacaggctttgaggcgattgattccatcgtaaaagcggagccactcgggccgaaacttccgctcgactgcatggtcatcgcccctttaaccggaaattcaatgagcaaactcgcaaatgcgatgaccgacagccccgtccttatggctgcgaaagccacgatccgcaacggccgcccggtcgtgctcggaatttcgacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaaaaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaagaatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtgtccggagccggcaatgaagcggcgaaagaattgtacagccagacaaaggcgattttaaacaatgaacccgcagaaccgtccattatgccggttaaaggcgacaaaaagcattatcaaatcgcatttaacgccattccgcaaattgataaattccaagacaacggctatacgtttgaggaaatgaaaatgattaatgaaacgaaaaaaatcatgcatatgccgaagctggaagtggctgcgacatgtgtaagactgccgattgaaacagggcattcagaatctgtttacattgagcttgaccgtgatgacgcaaccgttgaagatattaaacagcttttaaaagaagctccgggtgttacgcttcaggatgatccggcggagcagctttacccgatgcctgctgattgcgtcggcaaacgcgatgtatttgtaggaagaattcggaaagatttggacagagcaaacggttttcatttgtgggttgtttctgataacctgttaaaaggcgccgcttggaactcagttcaaatcgcggaaagcctgcaaaaactgaacctcgtataaaacaaacgtattttctataggcgaacagaagagagtaaggctctgcctgctctcttctgttacgtcagactaatttggagtgaaaatagtgaagatcattgttcaaaaattcggcggaacatccgtaaaagatgacaaaggccgcaagcttgcgctagcacacataaaagatgccataagtgaaggttataaggttgtcgttgttgtatcggcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagctcaggccggctttttaaccaatgcccagcatactgacgccaaaattatagaaatgaaaacagagcggcttttcgctgcactcgccagccatgatgccgtcgttgtcgcaggctttcagggagcgactgaaaaaggcgacacgacgacgatcggcagaggtggaagcgatacatcagcggcggcgctcggcgcggcggttgatgctgagtttatcgacatttttacggacgtggaaggtgttatgacagccgatccgagaatcgtggaaaatgctaagccgcttccgaatgtcacatatacggaaatctgcaaccttgcttatcaaggcgcgaaagtcattcatccgcgcgcggtggaaatcgccatgcaggcaaaggtgccgatccgcgtgcgctccacttattcaaaagacaaaggcactttggtgacgtcccatcattcgtctaacatcggcagcgatgtattcgaacggctgattacggggatcgcccatgtgaaagacgtgacgcaatttaaggttcccgccaaaatggggcaatacaacgttcagactgaagtctttaaagcaatggcaaatgccggaatcagtgtagatttctttaacattacgccgagtgaaatcgtatataccgtagccggcagtaaaacggaagccgcgcgcagcattttggctgaattaggatatgagccgacagtgacggaaagctgtgcgaaagtgtcagcggtcggcgccggaataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatccccgacactttcaacggaagaaaaaattgcactctttgaatttacagtcaaagaagtgaacggacgcgtgcctgttattgcgggtacgggaagcaacaatacgaaagattccattaaactgacaaaaaaagctgaagaagccggcgtcgattgcgttatgcttgtcacgccgtattataataagccttcccaagaggggatgtaccgtcattttaaagccatagctgaagaaacgtctcttcctgtgatgctttacaacgtgccgggcagaacggtcgcttcgcttgcgccggaaacggccatcagacttgcggagattccgaatatctctgcgattaaagaagcgagcggcgatcttgatgccattacgaaaatcattgccgaaacgccggaagatttttacgtctattcaggtgatgacgggttaacgcttcctattcttgcagtcggcggaagaggagtcgtgtcagtggccagccatattgtgggttctgacatgcagcagatgattaaaaactatacgaacgggcagacggcaaccgcggcactgattcatcagaagcttctgccgatcatgaaggagctctttaaagcgcctaatccggctccggtcaaaacggcgctgcagctgaaaggccttgatgtcggatctgtgcgtcttcctcttatcccgctgaatgaagatgaacgtctgagcctgagcagcgtcatcagcgaactgtaagaaaaaatttatacagttgaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcggggctgatgcaccctgaaaatgaaatgctcggtattgatgtcgtcattccggatatttcctacttagtagaacgggctgaccgcgtgaaggccatctttctgacacacgggcacgatgaaaacatcgggggcgtcttttatttattgaacaagctgtcggtgccggtatacggaacgaagcttacgcttgcattactgagagaaaaactcaagcagtacgggcataatcgaaaagctgatttacgtgaagttcactctaaatcagtcattacatttgaatcaacgaaagtatcgttctttaaaacgattcacagtattccggattcagtgggagtcagcttcaaaacatcacttggctctattgtatgcacgggagacttcaaatttgaccagacgcctgcttatcatcaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacaattcagaaaaccgtgtcatcattgctgtattcgcgtctaatatcaaccggattcagcaagtgatacaggctgccgtccagaacggccgcaaacttgcaatcgccggaaaaaatctgcaaaacgtgcttcagcttggacgcaagctcggctatattgaagccgaagatgaaatgtttattcctgtgcaggatgtgaaaaaatatccgaagcgggacgtggcaattgttacagccggaagccatggtgagccgctggccgctcttacgcgaatggccaagcaggcgcacaagcagcttaacattgaagaaggagacaccgttgtcattgcatcaacaccgattccggggcatgaattgatatattccaaaaccgtcaacctgcttgcccgcgccggcgctcaagtcattttcgcccaaaaacgagtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgacattttcttgattgaaaaaggtgatgtcgttgaattccgcggccagaatgtgaaaatcggggataaagtcacatacggaaacgttctgattgacggcctcggagtcggcgacatcggcaacatcgtgctgagagaccgccgcttattgtcacaagacggcattctcatcgtcgtgatttcactcgataagcagaagaagaaccttgtttcaggccctgagatcattacgcgcggtttcgtgtatgtcagagaatcagaggggttaattgtacaagctactgagctcgtccgctctatcgtgactgaagcgacggaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatgatgctccggctttgtttttgttcatgtcccggatggaaatcatcatctttgttcataatacaaagagacattcggaaagggtgaaagataaaatggatcatcgtatggaaaacaccgaagaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacatgtcattccgcaaatcgtcgccattgagcaaaatccgaaaatcgaaggacttctgatcatcttaaacaccgtcggaggcgatgtggaagcggggcttgcgattgcggaaatgctcgcatccttatcaaaaccgaccgtctcaatcgtactcggcgggggccactccataggtgtgccgatcgccgtgtcatgtgatcatagttttatcgcggagacagcgacaatgaccattcaccccgttcggcttacaggtctggttatcggcgttccgcaaacgtttgaatacctggataaaatgcaggagcgggtcgtcaactttgtgacccatcattcaaatatttccgaagaaaaattcaaagagctgatgttttcaaaaggaaacttaaccagggacatcggaacgaacgtagtcggcaaagatgcggctgattacggattaattgatgccgtgggcggcgtcggacaggcgataaaaaagctgaatcagctgattgaggaacgaaagggcgaggaaggaaggatgattcaatgatcctttataccgtcatgccacaagaagtcgtttacggtcaggatatagagcaaagcgtgcatgaacaggtagattacgccggcgtgccgctgctggttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgatgtatgattttacattttttaacgcagtaaggtgatgagtgtggcaaagaaaaaacggaaatctaaaaagaaacaagagagtaagctcaatctaaaatacgaactaagcggactgctctgtgttgcaatctcgattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgaggagaaaggcagggttgtactgtattatcgccagtattttgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtgctgtttgcagcttcccactttttatttgcatcaacgggttcacagatcatggcgatcgtgctgatcttaatggggctgattcttgtaacggggcgttcactgcaggaaacgctcaaaaagtggacgagccccgtcggccggtttatccgcggtcaatggcaggcatttcttgaggatatgaaaacggtcagaacgaatatgtcttcgccgaaaacaaaaaccaaatcgggcaaaaaacaaaaacgggttcaaaagagaaaagaagtgcctgagcccgaagaagaggatgaggaaatcatttcgccgatcatccattcagagccgattatttcaagtttttcagaccgtcaggaagaacgcgtcgaaccgctgattccggaaaaaacgcaggagacggcgcaaacggcaaaagatgagccttccggcggcgttcaagacagtgacgaaacggctgcggctccgccgatgacgtttacagagcttgaaaataaagattatcaaatgccttcattggacatcctggctgacccgaaacataccggccagcagaccgataagaaaaacatttacgagaatgcaagaaaactcgaacggacctttcaaagcttcggggtaaaggcgaaagtgacccaagttcatctcggcccggcggtcacaaaatatgaggtgtatccggacgtcggggtcaaagtcagtaaaatcgtgaatctgagcgatgacctcgcgctcgcgcttgccgcgaaggatatccggatagaagcgccgattccgggcaaatcagcaatcggcatcgaggtgcccaatgctgaagttgcgatggtttcgttaaaagaagtgcttgaatccaagctcaatgacaagccggacgcgaagcttctgatcggcttgggacgaaatatttccggggaagccgtgcttgccgaactgaacaaaatgccccacctgctcgtagcgggggcaacgggaagcggaaaaagcgtctgtgtcaacggtattattacgagcattctgatgagggccaaaccgcatgaagtgaagatgatgatgattgacccgaaaatggttgagctgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatattaagcggtcaaatgccgaagaagaagtcaagcagcctgagctgccgtacatcgtcgtcatcgttgacgagcttgccgatctgatgatggtcgcttcttccgacgtggaagattcaattacgagactttcacagatggcgcgggcggcgggaattcatttgattatcgcgactcagcggccttcagtcgatgtcattaccggtgttattaaagccaatattccgtcaagaattgccttcagtgtctcatctcagaccgattcacggacaattttagacatgggcggcgctgaaaagcttctggggcgcggagacatgctgtttctgcctgtaggcgcaaataagccggtgcgtgtgcaaggggcattcttatccgatgaagaggttgagcatgtcgtcgatcatgtcattacgcagcaaaaagcgcagtatcaagaagagatgattccggaagaagtgtcggaaacacacagtgaagtaacggatgatctctatgacgaggcggtcgatttgattatcggcatgcagacggcatcagtctccatgcttcaaaggcggttcagaatcggatatacgagagctgcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttattaaaacatgatatagttgtcccaattgttcaataatttatgaaagtggtttacggaggggaaacatgtctacaaaagctgacaatcgtcacttgtacctaaaagtgattgagcgaatcaaagaggatatacaaaacggaatttacaccgaaaaggaaaagcttccttctgaatttgagctttcaaaatctatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaatgattcagcaggcgaacatggtgccgggtacgatttttttgtcgtctcaggtcattacgccgtctgatgaagatatcgctagattccggcttgagcctgagcaggagcttttttatttggaacgcgtgagaacggcaagcggcactccggtcgtttactgtttagatacgattccgatgcacattctgccgaattctttctgtcatgaacaggaatctatttttgatcttttggaaaaaaactccgggtctgtgatcagctatgccgttgctgatatcgaaccgatcggatatcacgatacgatttcaccggttttggagtgcgagccggagacggcgcttttattgctgaagcaaacccactataatcagaatgatgaacctgtgctgtattcattaaattatttccgggctgataagttcagttttcatgttgtaagaaaacgtttttaagacagacgcgtcatgtgtctgtttttttatttgccgcttcaatacatactttgttttccgcaaggcacaataaaacaggaaacaaccaagtatagtgaatgggtgaataagttgagtaagaagaaaaatggaacaaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggcgattatttgtattccgattgccggatatttgtccgataaattcggaagaaaaaaggttcttctgccttgtcttctcatagccggtgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgacattgagacgtcaaacacggccgggaaagtattaagcccgattctcgggtcgctcttggctgcatggttttggtttatgccgttttggttcattccgtttttttcgcttatcagtttttttctcgtattgtttttggtggcaaagccggagaaacaaaaagaagccccttctatttccgaatttgtaaaaaatgtcggccgcatatttaagcgtgacggacgctggctctttacggtatttatcatcggctgcgtgattatgtttttgctgttcggggttcttttttatttatcagactcactggagaagaaatacggaattgacggtgtggctaaaggagcgcttttggcaatcccgcttttatttctatccgtcagttcatatatatcaggcagaaaaatcgggaaagaccaaggcaaaatgaagttctgcatcgttttcggaatgagtgccgtgacactgtcgtttatcggcctatggtggaatcacagtttttatttattatttatctttttgtgtgtcagcggtatcggtatcggaatagcattaccggcattagacgctgtcatcacagaaggcgtagacaacgaggaatcgggaaccatcacctcattttataacagcatgcggtttatcggagtagctgcgggaccgccgatctttgctgccctgatgtcaaatgcaggctggctgatttttattttatccgctttttgcggcattgtgtctgtatttttagcgctgttaaatatctcatcacaagcaaaagaaaaaaaggaatcattaaagacggtgtaatctgcactgtctttttttattttattttgaagattgacatgatatcgtcaagtcgttatcctttttaatagttaaacattttaactattggaaggagggggaaaagatgcatgaagaaaaagtaaagcagctgattcagcgttattccgatgtatacctgcacgtcttaaaaaaaattgacagcattatcgctgaaaaagtgaacaaagagctgacattggatcaatattacatactccgctatattatgctcaatccggattgcaaatcaattgaactggccgcggtgtgccacgtcaacaaaagcgccattacatcgatgacgaaccgcctgtatgaaaaaggctacatcaatagagaacgcagccaaagcgaccgccggagcatacttttaaatgtcacggaaaaggggacggaagtatttcaccgtgtggagcggcggattgaggaactcgtccgttcatatattatgtattttgatgaagacgaggcggagatgttcgttaatacatatgaaaaattatatcgattgatgatgacagaggaggatcagcagacataatgaaaaacattatccgagcccgctggatcatcgccgcggtatggatcgccgcaacggtgatatttatgcttacagcgcctgatatggctgaattgacacgggagaaagggcagatttccgtaccggacggatattcctcttcttatgcccatgaattgcttgatgaaatgtctgattcagatgcaccgtcttcttctgccgtcatcgtatttcacgaaaaaggcttaatgacagacaaaaaagatcgtctggaagaagccgtcagcactttgtctgaacagaaaaaagcgcttcagattaaaacggtgacttcatacttcggggagaaaaatgacgacatcaaaaaacagctgctgtcaaaagacagacaaacgatgctcgttcagctgcagcttgatacatccaaaaacgatatcctcgaaatcaaaaataaaattgataaagagctgaaaccgtacggcgtatcatacggcattacaggccagtcgctgatcgatgaagatgtgttaaaaagctcacaggacggattgaaaaagactgaatatataacggtcgcttttatcctgatcgtgctgatccttgtattccggtcagtggtcgctccgtttgtgccgcttttatctgtattgatatcttatttagtcagccagtcgattgtcgcatttttagtcgaccagctgaattttccgctctcaacttttacgcagattttcatggttgcgattatgttcggaatcggcacagactactgcattctgcttctcagcagatttaaagaagaactgtcgcatggcgctgatataagagaggcgatcgtcgtcacctacaaaacggccggaaagacggttttgtacagcggcggtgcggtgctgatcggatttgcctgcatcgggtttgcgacatttaagctgtatcagtcggcagccgccgttgcggtcggtgtcgcggtgctgctgcttgcgctcatgacgatcgtgccgttttttatggctgttttaggaaaaagactgttttggcccgttaagggtgatatttcccatcctcaaagtaaagcatgggaaacggcagggcggttttcatttaaaaggccgctcatcagtcttgcaatcgttgcggtattcaccgtcccgccgatccttctttacaaaggatcgctatcttacaacagccttgacgaaatcggggataaatatgaatccgtccgcgcgtttaatacgatttcagacgcattcggcccgggggagcttcttccggccacagtcgtcatcaaaaatgatgagcctctaaataccgaaaaacacctgattgatatcgaaaaaatcagcagagaacttgaaaaaacagagggtgtaaaaacggtcagaagcgccacgcgccctgccggaaacggattgaatcaattatttgtcacaaatcaggcaaagcagcttcaagaagggcttgataaaggcaatacaggacttgaaaaaatcacggacggattagggcatgccgcaaagtcgttagctgattcacagccgcagatcgaagagtcggggaaaagcgtcaatcagcttattaacggaacattgtctctgaaatccgggctttctgatataggcgaaaacctgaataaactgcaggctggcgtgaatgagaataaagccggcgtcgcccagatgagaaagcagattgaagagcaaaaacaaatgctgacttcacagctcaaacaaaacagcggtctcgcttcagaaacgcaaaacgctttaaaattggtaaaaaccgtcctgccgatgaaagatgaagccagcagacagcttgccgatttgaacaagcagcttgcccggctgccgtttgcaaaattggaagcgtcaataccgtcagtcaaaaccgatccctcttacaaagaaatcaaatcggcctttacgggtgtacagtcagccgtttccaaggcaaacgcggatgcagaagcgttttctaaacaggtcgacagtcaaaaggatcatctgcagcaagcggaaaaacaatttgcccggctggcagccgctcaaaaaaagatcgacactcaaattaacgcaatgatcaacggtctgaccagtattgaaaacggtctgcagcaagtgtcagacggacagggggctcttgcaggacaaatgccgcgccttgaatcggcggcaggacagctcgcggagggccagaaaaaaatgaagagcggtctcggtgatttttcttcccggctcagcgatctttcttcaggccttaacgatagtgtaaaagggcttaagaaagtatcaagcggcatgatgggggcgaatgattacctgggtgagcttcacaaggcctcagataaagaaatgacaggctggtttgtgccgaaagacgcgttgacaaacagtgatttcacaagcgtgtttaatacgtacatgtcagatgacagaaaaacgacagaattgaccgtcgttcttgataacaatccttactcaaatacggccattcaagatattcaagcgatcaaagcgagcgtaaaaagggccattccgaacacggatctgaagaatgcctctttcggcgtttcgggagtctccagcatgaatgccgatctgaaagaagtatcggattcagacttcaaacggacggcaatgtttatgctggcgggaatttttctgattctcatcataatgctgcgctctctcattatgcctgtttatttagtggcgtcgctcgtactgacgtatttcgcatccatcggcgtgacggaatacatctttacacacttcttcgggtatccgggcgtaaactgggccgtgccgttcttcggctttgtcattttgatggctcttggtgtggattattccatctttttaatggaccgctttaatgagctgaaaaaagaaggaacggaacccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtaccggtcatggtgaaaatattcggaagagccaactggtggcctttcaatttgaaaaaataacgttcaatgcctctgcctgttttcgggcagaggttttttgtttccttataaatcctccagttgatataattacatctgcgcactcttttttgcgaatcctgaaatttggccataatacatactattaaagaatgaacgaaggaggtttcacatgacttacgtaaatgaaatgaagtcaaagcacggcgggatcaccgcccacatcgtaaagactgagaaatttaaaaccgtttcgctgacgtttaaaatgctggctcctttaacgaaagagctcgtaacaaaaagggcgctgtttccgcatgtgcttctgcgcggaacagaaagccgcccgaaaaccgctgatctgcgttcttattttgatgagctgtacggcacatccgtttcagctgatctgactaaaaagggagaacgtcatgtcattacgttcagacttgagattcctaacgaaaagtatctgaaggaccgcacaccgttattggaaaaaggccttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcccttcacgtcaacggcgagttcgatgatgttgaacacattacaccgcaagatttgtatgaagcctatcaaaaagccatacgcgaagatcagctggacctgtacgtcatcggcgatgttgattcagatcaggtgaaaacggccgttgatacgtattttaaaacggaagaacgggagctgcagccttttgaaagaagcgcggcgaatgaacagcccgatccgaaggaagtcattgatgaagaggacgtcaagcagggcaagctgaatatcggattccggaccaatacgacatatacagatccggattatccggcattgcaggtgtttaacgggctgttcgggggtttctctcattcaaagctgtttataaatgtccgtgaaaaagcaagcctcgcctattatgcagcctcaagggtggaaagcttcaaagggcttttgatggtcatgtcgggcattgaggtgaaaaattataagcaggccgtcaccattatcgaagaacaatttcaggctatgcaaaacggtgacttttcagaggacgatatcgcccaaacgaaagccgttattaaaaaccaagtgttagaaacgattgatacggcatacggcttagcggaatttctgtatcagcaggcttcagcccaagtggaaataccgatcgaaactttcctcgacaatatcgagaaagtgacaaaagaggacattatcaatgtcggaaagaacattaagctggatacgacttatttcttaaaagggacggggggagcatcttgactaaaccgataaatttcgaacagcttcaggaaacgctgtatcatgaaaaaatggcaaacggccttgatgtctatgtgctgccgaaacacggttttaataaaacatacgccgtgtttacgacaaagtacggttccattgacaatcaattcgttcctttaaataaggaagaaatggtacacgtgcctgacggaatcgcgcattttctggaacataaactgtttgaaaaagcggacggcgacgtgtttcaggacttcagtaagcagggggcgtcggcaaatgcctttacatcatttacacgaaccgcttatctgttctccagcacttctaatgtagagaaaaacctggaaacactcgtggattttgttcaggatccgtatttcacggaaaaatcagttgaaaaagaaaaaggcatcatcggccaggaaatcaatatgtatgatgataatccggattggcggctgtttttcggccttatcgaaaatatgtataaagaccaccctgtgaaaattgacattgccggaacggtggagagcatctctcatattacgaaagatctgctgtatgagtgctacgaaacgttttatcatccgagcaatatgctgctctttatcgtcggtcccgcagatcctgaagcgatcatcagccaggtgcggaaaaaccaggagaaaaagccgtttacagaccagcctgaaatcaaacgtaaagaggttcaggagcaggaagcggttttccgccgggagcaggaattaaaaatgaacgtgcaaggctcaaaatgtcttgtcggtttaaaggcgaaagacccttataaaacggggcgggagctgttgaagcacgagctcagcatgaacctcatgcttgaatgtctcttcggaaaaagctcaccgcattacggcaacttgtacgataaaggctacattgatgaaaccttcagctttgattacacggctgaatacggattcggctttgcctctgtcggaggagatacaccggagccggataagctcgctgacgaattaaaacagatgctgcttgatgcagaatcagccgtaactgcggaaaaacttgaccttgcgagaaaaaagaagatcgggtcatttttaaaagcgctcaattcgcctgaatacatcgccaaccaattcacacgctacgcctttttagatatgagtctgtttgatgtcgtaaccgtaatggagcagatcaccctggaagacgtaaagcgggtcattaaagaagaaatatcagaagacaggctgacagtctgcaaagtcgtgccaaaatcataacaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctaataaggaagccgcacacaggcttgcggaaaggctgagcgcatcattcggcgtaaaagcctccgctattcaggcggatctgtcctcaccggatggcgcggagacactcagccgttccgttaagcagcctgtggacgctctgatattaaacagcggcaaaagtcatttcggcctgattacggacgttacggatgacacggcgcgggagatggtgcagctgcatgtgacgagtccgtttcttttggcgcgtaatctggtgcccggcatgatccggaaaaaaagcgggggcattgtcgcgatcggttccgtctggggagaaacaggtgcatcgtgcgaggtattatacagcatggtcaaaggagcgcagcattcgttcgtcaaagcgcttgccaaagagctcgctccgagcggcgtccgcgtgaatgcggtctccccgggtgccgttgatacaaatatgcttgatcaattcacgtctgatgaaaaagaagcgttggcagaggaaattcccgcgggccggctggcaaagccggaggaaatcgccgaagcggcagcctttttattatcggacaaggcttcctatattacggggcatatattatccgtaaacggcggctggcactgctgaaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacgatcactgacctcgcgacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagctgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccggggaatgccgagggtcggaaagacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaagtcgtggagcaccccgatatttttgttcaaaattcggagtatacgctcgatgatttcgattatattattgaactcagaaatgatcctgacgaagtcattacatatgaacatgcagaagaaccgcaaatgtttgatcagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcagtacgctgaagctgtcgggcttgattcagatcagttatttgaagaatataaaaaagacatccctaacacgtaccatgacgatgtgtcggaaaaaatctccggtctcgccatgcaaagggagcttcctaagtccgcttcaaaggcggcggaatggcttccgaccgtccttgtcgtcatcggtgtcattatcgtcatcgcgatcatttatgcgattattcagttcggaatgagcaaatccgggcagacagacggagataagaccgtcacccaaagtgagagcaagtatgagattcctaaggattctgcgctgaaaaacgacggcaatacaaacgacgaagcgcaatctgacagcaaaaaagacaaaaaagacacaaaagcgtcagagcagaaaaagaaagaaaaaagcagtgaaaagacggagatcaaagcggccggaacggaaggctcggcttcttcatacaacgtctccggggcagataagtataagcttgaactgattgcttctgacagcgcgtggatccgcgtccgtgatgacagcggcggttctttaaaagaaggaacgctgcaaaaaggcgaaacctttaaaaaagacgtcacggatcaaaagcagattgaaatccgcacgggctatgcccccaacctgaaaattaaaatcaacggagaggttctgtcctatgaactcaatccgcatgatgtgatggcgcagaccatcacaatcaagatgaaaaaataaaaggggaaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcattggggcagcgttcatataggggatgaatcgattccggtcgcgcatcttacgggagctgttttgttcattatcgcatcaacgactgactgggtggatggctactacgccagaaaactgaacctcgtgacaaacttcgggaaatttttagatccgctggctgacaaactgctggtgtccgcggcattaattacgcttgtgcaatttgaccttgcgccggcgtggatggtcatcatcatcatcagccgcgaatttgccgtaacgggattaagacttgtgctggcgggaacgggggaagttgtagccgccaatatgctggggaaaattaaaacatgggcccagatcatcgctgttgccgcgcttttgctgcataatcttccgtttgagctcgtttctttcccgttcggcgatatcgctttatgggtggccgtgctcttcacagtcatttccggctgggattattttgcgaagaactgggatgcgttaaaaacatctaactaaggaagaaggacttaaagatggaaatagcaaaaaaagcagaaatcattgcggtcggctcggagcttctgctcggccagatcgccaatacgaacgcgcagtttatcagtaaagagctggcggaaatcggtgtaaacgtgttttaccataccgctgtcggtgacaatccggagcggcttaagcaagtcatccgcattgccgaagagcgctcagacctgattattttttcaggcggtctcggaccgaccaaggacgatttgacgaaagaaaccattgcaaacacactggggcgcccgctcgttctgaatgacgaagcgttccggtcgatcgaagaatatttcgcgaaaacaaaacggaccatgtcgccgaataaccgcaaacaggcgctcgtcattgagggctcggacgttttggcgaatcatttcggcatggcgccgggaatgcttgcagagcacggctcaaggctttatatgctgcttcccgggccgccgagcgagctgcgtccgatgtttgaaaatgaagcgaaaccgctgcttcttaaaaagcttggttctaatgagaaaatcgtttcaaccgtgctgcggtttttcggaatcggtgaatcccagcttgaagctgatttagaagatatcattgacgcgcagacgaatccgacgattgcgccgcttgctgctgacggcgaggtcacgctgcgtttaacggcgaaacatgctgacgaaaaagaaacagaacggcttttaaaagaaacggaagccgccattttagaacgtgtcggtgaatttttctacggatatgatgatacgtccctggtgaaggagctttcaaaagcatgcagacaaaacaaaatcacgatttcttctgccgaaagctttacaggcggcctgttttcagagtgggtgactgatttaagcggtgcgtctcaactatttgcaggaggcgttgtctgctattccgacagcgtgaaacagcatgtgctcggcgtgaaagctgagacgctcgcagaaagcggagcggtcagcaaagagtgtgcgaaagagcttgcagccggtgtgagaaagctgaccggaagcgatatcggcatcagctttaccggggtcgcgggtcccgacccgcaggaagggcatgcgccgggccgcgtctttatcggcatatcaacggaaggaaaagaagaggtgcacgaatttcactttgccggctcaagaaccggaatcagaaagcgcgccgctaaatacggctgccatctcattttaaaaatgctggatcaaaaataaagttttaaagagcttttttctctgatttttaagtttcataagggaaattatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacggatacaagaatttcaacggtgccaagcggctcccttgcacttgatactgctctcggaataggcggatacccgcgcggacggattattgaagtatacggacctgaaagttcaggtaaaacgactgtagcgcttcacgcaatcgctgaggttcaggaaaaaggcggacaggcagcatttattgatgctgagcatgctcttgatcctgtttacgcgcaaaagctcggtgtcaatatcgaagagcttctgctttctcagccggatacgggggagcaggcgcttgagattgctgaagcgctggtgcgaagcggagctgttgatatcgtagtcgttgactctgttgcggcgcttgttccaaaagctgaaattgaaggtgacatgggtgattcacacgtcggtttacaggcgcgtcttatgtctcaggcgctccgtaagctttccggcgccatcaataaatctaaaacaatcgcaatctttattaaccagattcgtgaaaaagtcggcgttatgttcggaaatccggagacgacaccgggcggccgcgcgctgaaattctattcttccgtgcgtcttgaagtgcgccgtgccgagcaattaaagcagggcaacgacgtgatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtgcaaaaaagcggttcgtggtattcttatgaagaagaacgcctcggtcagggccgtgaaaacgccaagcagttcttaaaagaaaataaagacatcatgctgatgattcaggaacaaatccgtgaatattacggtttagacaataacggtgtaacggacaaagcggaagaagttcaggaagagatggaattagaagaataaaaacacgatcaaaagagcggaataagcaatttccgctctttttttttgtatgtttcaaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcatcgggagaaggaatccgttaaaaacgctcccgccgctcaatctgatacttcaaaagaccagactcaacagaaaaaagaaaagacgcaaaaagagaaaacacctaaatcaatcgatcacaataaacagatcagcaattacttgcaacagatcgggttcagcggcacagcaatgatcgtaaaagatggaaaagttgtgctgaaaaaaggctttggctatgcagaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcatcacattgaaaaacctgctcaatcatacgtccggcataaacgggcatattgagggtcggggaccgatttctccaattgatttaatcaaggatatagaataccgcggaattaaaaggcagcccggggtttgggattacagggattccaactattcagtgcttgcttatatcgtatctcaggtcagcggggagtcttatgaacaatatataaaagaacacgtgttcaaaccggccggaatgaagcatgccggattttacaaaacatttgctgaagccaaatatcctgccgtcggctacaaagtcgatgagagcggcagtcttgtaacgccgcaccttttggacttatcgcagctttacggggcgggcgacatgtatatgagcgctgaagatctctataaatttgataaagcgatcgtaaacggcacgctcctttcaaaagaaagcttcacaaaaatgtttacagcaggaagcagtgccgcttacgggatggggttttacattgatccgggcagctattccaatcacggtgttatgcccggttacaacattttaaacagtttcagccattcggcaagcaaatatgtcatattactgtcaaacattcagaataacgccaaattaggacaggtaaacaatagaatttaccaattgcttaaccaggcggactgacagagccgtcattcacgaaaagcggatgaaggtatggtatgatatatacatgggcggcgatccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcagacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacatgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaatattcgtacgcttgaaacgcttacaggtattgacctgattattgatgacacacctgaagcagtcattctttccggatttgatccgatcagacgggagacggcaagaatcgctcttgataaactcgttcaggatggccgtattcatccggcgcgaattgaagaaatggttgaaaaatcccgccgtgaggttgatgactatatccgggaaatgggtgagcagacgacgtttgaagtcggcgttcacggacttcacccggatctgatcaagatcctcggccggttgaaattccgtacaagctacgggcagaacgtactgaaacattctatggaagttgcgtttttagccggtttaatggcttccgagcttggagaagatgcaaagcttgccaagcgggccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggttgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcgcgtgatatccgtaaacgaattgaggacgagcttgattatccgggacacattaaagtgaccgtgatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacggaaaagatctaccacagcctgatggaagcgggagccgacgccattacaatgggaaaccatacgtgggataaaagagagatcttcgactttattgatgatgtgccgcatcttgtccggccggcgaatttcccggaaggtacgccgggcaaaggcattacttatattaaatcgaacggaaaagagcttgccgtcattaatttacaggggcggacgtttcttccgccgcttgatgatccgtttgctaaagcggatgaattaatagaagaagcgaaaaagcgcacaccgtacatttttattgattttcacgcggaagcgacaagcgaaaaaattgcgatcggctggtatacagacggaagagcctctgccgtagtaggcacccatacacacgtgcaaacggcagataaccgcattttgccgaaaggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggcgtattgagggaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaacatgtacattctcaacctgcttgcgtaaggcgagcaggttgtttttattgctgtcatattttctcacaatattatattgatagtacgaagagatgataaatggctttattcatataatattcaaaaaaaatcccgcccatttttccggacggaagcagttgttttcctagagtggacactggtgtttacctcctttttatctcatgttacaatccagttattacagtgttttttcgaggaggagtgtacatgttgggaggaaagatgaaagctatcgttaaaaatgaaaacgctttcggagcaaaactgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacgggcaagcacgtcacaaatgtcaaaataggtgactgcgtttcggctgaaacccacttcgtctgcggtacttgtgtcccgtgtttaacaggaaaacatcatgtgtgcacccatacaaagatcctcggcgtagatacagccggctccttcgctgaatatgtcaaagtgccggcccgaaatgtttggaaaaaccccgctgatatggaccccgccgtcgcctctgttcaagagccgcttggcaacgcggtgcatacggtgctggaaagcagcgggcttgcgggcggttccgctgcaattatcggctgcggaccgatcgggctgatggcggtggcggtggctaaagcggccggtgcatcccgtattgcggccattgataaaaatgattacaggctggctcttgcgaagaaattgggagctgcgatcaccatttcagctgatgaggaagatccgcttgaggtgatcgacaccttaacaggcggagaagggatcgaccttgtctgcgaaatgtcaggccacccggcagccataacacaaggattaaagatggcggccaacggggggaggttccacatgctgagtctgccggaacgtccggtgacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggacagtgcggcaaagtcattttgattccataaggggaggattctataatgaaagaatttgaatttctaaaagcagagcttgataaaatgaaagaaaataaaacgtggcagcaaatgaaacaaattgaaacgaagcagggtccgtcggtggaagtcaaaggggaaaacgtgatacagctttcatcgaacaattatctcggtttgacgtcgcatccgagacttgtcgaagcggccaaacgcgccgcggaagaattcggagcgggtacggggtccgtccgtacaatcgccggaacattcgaaatgcacaatgagctggagaaaaaattggcaacctttaaaaaaacagaagcggcacttgtttttcaatcggggttcacaacgaatcagggcgtcttatcaagcattcttacaaaagaagatatcgtgatctctgacgaactgaaccatgcttccattattgacgggatcaggctgacaaaagcagataaaaaggtgtaccgccatgttgatatggacgatttggaaagggtgctgaaaaaatcaatgaattaccgcatgcgcctgatcgtcaccgacggcgtattctcaatggacggcaacatcgctcctttgcctgacatcgtcaaacttgccgaggcgtacgatgcctttgtgatggtcgacgatgcgcatgcttccggcgtactcggaaaaaacggaagggggacggttaatcacttcgggcttgacggaagagtccacatacaggtgggcacattaagcaaagccatcggagtgcttggcggttacgccgcagggtcgcaggttctgatcgattacctgcgtcataaagggcgtcctttcttattcagcacttctcatccgcctgcagtaacggccgcatgcatagaagccattgacgtcctgctggaagagcctgagcatatggaaaagctatgggagaacacggcgtatttcaaagacaaactggttcaaatggggctgaccctcacaaaaagcgaaacaccgatcgtgccgatattaataggtgaggaagaaaaagcccaggcattatcagaccttttattgacccgcggcgtgtttgcacaaagcatcgtctatccgacggtcgcccaaggaaaagcgagaatccgcaccattattacggcggagcatacaaaagaggagcttgaccgggccctggaagtaatccgttcagccgcaaaagagcttcagcttgtgtaagggggaaatgattccctcttttttatttcttattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccggcggacaaaaaatccgaaaaggattacagcaagtattttgaagccgtatatattccgccttctttaaaagatgcgaaaaaacggggcaaagaatccgttcaatatcataacgattttaaaatctctgaagaatttaaaggccttggtgaaggcaggaaattttatatccgcacgtacggatgccaaatgaacgagcatgatacggaagtcatggcgggtatttttatggcgctcggttatgaagcgacaaattcggttgatgacgcgaacgttattttattaaacacttgcgccatccgggaaaacgctgaaaacaaagtgttcggagagctcggccatttaaaggcgcttaaaaaaaacaacccggacttgattctcggcgtctgcggctgcatgtcacaggaagaatcagtcgtaaaccgcatccttaagaagcacccgtttgtcgatatgattttcggcacgcacaacattcaccgtctgccggaactgttatcagaggcatatttatcaaaagagatggtcattgaagtgtggtcgaaagaaggggatgtcattgagaaccttccgaaagtccgcaacggaaaaattaaaggctgggtcaacattatgtacggctgcgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccggttcacgacgagtcatccgcgtgactttgatgatcatctgatcgaagtgctcgccaaaggcggcaaccttttagaccatatccatcttccggttcaatcaggaagctcagcgatgttaaaaatgatggcccgtaaatatgacagagaacgctatctggagcttgtcggaaaaattaaagcggcgatgccgaacgcttcactgacgaccgatattattgtcggttttccgaatgaaacggatgaacaatttgaagaaacgctttcgttatatcgcgaagtggaatttgacagcgcatatacgtttatttactctcctcgtgaaggcacgccggcagcgaagatgaaagacaatgttccgatgagggtcaagaaagaacgtcttcagcgccttaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataataatgacgctttactcaaagaaagacattgtacagcaggctaggaaccttgcgaaaatgatttctgaaacagaagaagttgattttttcaaacgcgccgaggcgcagattaacgaaaatgaaaaagtctctgcgattattaatcagattaaaaccctgcaaaagcaagccgttaacctgaagcactacgaaaagcttgaagcgctgaagcaagtggaaagtaaaattgacgccctgcaggaagagcttgaagggattccgatcattcaggaattcagagattcccagattgaggtcaatgaccttcttcagcttgtcgcacatacgatctcaaatcaggtgacaaacgaaattattacatctaccggaggcaacctgctgacgggagaaaccggttcaaaagtaaaacattcgaataacagctgttctatttaaacacggggccttcatcggcccgtgtttttttgctgtttaagaactaattgtaatatgtactaaattttcattgtctcaacgttttgtcctatttttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcgcctggagaaaaaccgtcaagtatactgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagatacaaattacttagatgacgaacacgaagtcattgccaaagtgctgcagcagccgaattgtcttgaagtcaccatttctcctaacggaaataaaatcgtggttcaggcagagagggaatttttagcagaagtggtcggtgaaacgaaagtcgtcgtcgaagtcaatcctgactgggaagaagacgatgatgatgattgggaagacgatcttgacgaagaattagaggacattaaccctgaatttttagtcggagatcctgaagaataagttgaggctaggggagtttaacaccccgagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcgcaagagcttgaaattacactgacaagcagagacggaggttcggctgataaaattccgatgtgcggcgtgccgtatcattccgcggcggcttatattgaacagctgattaaaaagggctataaagtggcgatctgtgagcagacggaagatccgaaggcggctaaaggcgttgtaaaaagagaagtcgtccagctgatcaccccgggaaccgtgatggatggaaaaggcatccatgagtcggaaaacaactttatcgcttccgtttccgaatttcgtaacggatacggtctcgctttatcagacttaacgaccggagaaaacctggccgtatttattgagcggattgaagatgtcatgtcagaaatttactcagtcggcgcaaaggaaattgtcgtatcaagcaagtttaacgaacatacggctgctcagctgaaagaacggtgcggcgcaacgatttctatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcgatgggcggccggcttctcaaacaatggattgaccgcccgctgatcagggcatcccaaatcgaagaacgccaggaaatggtcgagacgctgatcaatcatctgtttgagcgtgaagatctgcgcgagcgcctgaaggaagtatacgatttagaacgtctggcgggccgggtcgcattcggaaacgtcaacgcaagagatttaatccagctgaaagaatctttaaaacaagtgccgagcattaaagagcttgtaggatctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaggacgggcggtatgagcggaagcagaccctcacaaacgccgaacggtacattacgccggaattgaaggaaaaagaagcgcttattttagaagcggaaaacaacatctgcgagctggaatatgagctttttgccggactgcgtgaaaaggtgaaacaatttattccgcgtctgcagcgtcttgccaaacaaatgagtgagctggatgcgctgcaatgctttgctacgatcagtgaaaacaggcattacacaaagcccgtcttttctgataatgaagtaaaagtcattgaagggagacaccccgtcgttgaaaaggtgatggacagtcaagaatacgtgccgaacaactgcctgatgggcgattcgcgggaaatgctcctgattacgggtccgaatatgtcaggtaaaagcacgtacatgagacagatcgcacttctatcgatcatggcccagatcggctgttttgtgcccgcaaaagaagcggttctgccgatttttgatcaaatcttcacgagaatcggggcagcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcatgatcatatcggcgctaaaacactgttcagcacgcattatcatgagctgacggtgcttgaagataagcttcctcagctgaaaaacgttcatgtgcgcgcagaggaatataacggaacggtcgtgtttctccatcaaatcaaagaaggagccgcagataaaagttacggcattcatgtcgcccagcttgcggagctcccggacgatctgatcagccgcgcgcaggagattttgaaacagcttgagcagacgggagataaaccggagcttccggcggcacctgagaaaaagcccgccgtcaaagaagaaccggcacagctgtccttttttgctgacggtgaaaaagaacagaaggcaccggcggtttctaataaagaaaaacaagtgcttgaagcttttaagtcaatcaatattctcgatatgacgccgcttgaggcgatgaatgaaatgtacaagctgcaaaaaaaattaaaatagaaagaggtgacggacttggcaaaagtcatccagctgtcagatgaactttcgaataaaatagcggccggcgaggtggtcgaacggcctgcctcagtcgttaaagaattggtggaaaacgccattgacgcaaacagcacagtcattgagatcgacatagaggaagcggggctttcgtcgattcgggtgctcgataacggcgaagggatggaaaccgatgattgcaagcgggctttccgccgccacgcgaccagcaaaatcaaagatgaaaacgacctgttccgggtgagaacactcggtttccgcggagaagctttgccaagtatcgcgtctgtttctcatctggaaatcaaaacgagcatcggcgagggggcgggaacccatctcattcttcagggcgggaatatcatttctgaacagaaatcctccagcagaaaaggaacggagattatcgttaccaacctgtttttcaatacgcccgccagattgaaatatatgaaaaccgtgcatacggagctcggcaatattacggatgttgtcaaccggattgctcttgcgcatccggaagtatccatccgtctgcgccatcaggggaaaaatctgctgcagacaaacggtaacggggacgtgcgccatgtgctggccgcaatttacgggacggcggttgcgaaaaaaatgataccgctccatgtcagctcgcttgattttgaagtcaagggctacatcgcgcttccggaaatcacgcgtgcatccagaaactacatgtcatctgtcattaacggcagatacattaagaattttccgcttgtaaaagcggtgcatgagggctatcacacacttctgccgatcggccgccatccgattacgtttatcgaaattacgatggacccgattttggtcgatgtcaatgtccatccgtcgaagcttgaagttcgcctcagcaaagagacggagctgcatgagctgatccgtgacgggataaaggaagtgtttcaaaagcagcggcttattccgagcgcccagctcccgaaaaaaacagtgccggcaccggccaaaaacgaacagcaatttatgacattcgaggaaagcgcgcctgagcggaaacttcctgaaaaaacgccggagccgtcttactcaccgatgaagctgagttcggtcgtaaaagagccggagccggtcatagaagaagagtccctgccggatgaagcaggtcacggagtgccgccggagctcggcatgccggtaacggaagcgcctgtttccgatattccggagcctgaagaggaggctgactctgaagaaatacgggaagaaagagttccggtgatgtatccgatcggccaaatgcacgggacgtatattttagcccaaaacgaaaacggcttgtatatcattgaccagcatgcggcgcaagaacggattaaatacgaatatttccgggagaaagtcgggcaggtcgagcctgaagtgcaggatatgatcgtgccgctcacctttcattatgcggcaaatgaagcgctgatcattgaccagcatcagcatgagcttgaaagcgtcggagtatttttagaagcattcggcacgaacagctacatcgtccgctgccatccggcctggtttccaaaaggggaagaagctgaactgattgaagaaatcattcagcaggtgcttgacgccaaacagatcgatattaaaaaactccgggaggaagcggccattatgatgagctgcaaaggctcaatcaaagcgaaccgccatttgagaaacgacgaaatcaaagcgctcttggacgacctgcgccgaacgacaaacccgttcacatgcccgcacggccggccgatcattatccaccacagtacgtatgagatggagaagatgtttaagcgtgtgatgtaataacaacgtttatgtgagactaaaccgttatttacccacaagcagccttactagtttgaatgacccagcctttcagagataacttttgagttttttaatttctggcataattgttgcatggtataccgtaaatcatgaagataatttgtttaacatccagctgcttttctgtcatataaaaattgtttatgggtagtaattggggttggcgatgtagtatcctgtgtttggtgtaaccgtctatatcgtcaattgactgcattaatagtgaaataatggagaaaacgattcctgaaaaatctcatgctatttgtgaagaatttaaataaaattggaatttggcgagttatactatccgcaagttagtcaagggggactagtaattagtcccccttacatttagttctttctgcggttttttctatttttgatcaaactgaaaaccactaagagaaccacaccgatagcaacaatataaaatgaaatttccgctgcggcggtgttaatattcttaagaacaaggataagccctattaaaaatataggaatgatgtaagttagaattcttatagctttcgggctcggttcagcattacttttatcttccatagttacctccgatcttaaacactttagaaaataatcactttaaagcttaacacaggataaatttgttaaacaccaacaatagccccgtttaaaggaaaagcataagagttttagtaacccacaaagttgctgccgggttgccagttacttttagagcatccgcatagcacgcatcttcaactgcaccagtaaaattgtcaatgatattaagaattatttcaaaaccgccgattccacccatagcagctttaactttagtaggtattgcgtcccgagctgctttcagtgcttttatagctcaggacaaatcaccttgagcagtaaactccgacccatataacatagtctatttgtctaaatcttaatatttactttttacacttaatgattttatgttagttttgtttttgcacagtaaaaagataactttatttagccctaacaaaaacatctgagctccttgtcaataatcaaatataaatcgtcttcaactgacgtcttttttcatgcgcgacgctttcgtgaattgttgcagctagacttgtttttgaacggttttctcgcaaaagaaaagagtgtaaattaagccgtacttttctcagttcaattatgttaatgtcaacataacgttgaattcggtgtaagaactaaggtattctgatatatttcgagagcccgtgtggtttagtttatctgaagaaaaggattgaaataataatcttaattgcgggtcatttctaaaaactgattatctcctccggccgcttctgtaattgcttctcaaaacaaaagctcaatttgttttctttttatccgaaactcataatcatccttcattttctgaataaaattccctaaagaattcatctgaattaatattctgatttccttatatatcagcatagcaatttgtaaaaaaggcccagactggtgcttttggcgggagcagaaagttttttaaactttaccggaaaatccatggaaaaacgtggtgccatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggacccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggacaaacctttgcggccggagggtttatcatcagaagtatattgaccccgggacatacggccgggggaatgtgctatttgctatctgatcacctttttaccggtgataccgtgtttacagaagggtgcggtatatgtgaggacaggggcagctcagctgaagatatgtttcacagtatacagaggatcaaagcctctattccgccgcatgtgcgtgtgtatccggggcactccttcggggagaagccgggtcaaaaaatggagagtcttttgaaaaacaatatttactttcagattgaaaaaaaagaacatttcgtgaacttccgcaacagaaaaaatcaaaaagggctgtttcactttaagtagcgtataatttggttctatctaactagtttttcttttaggccacggaacttctgaattgaaatgatagtcattgctcgctttttggtgatgaatggctgagtaacggtagtttgcggataaaagcgccgggcaggctgaatgggacattctgcttatatctattccaaaagccctgagtccgccttccgtcagggaaaaataggcattattcaggattccgcataggataaattaacttgacatggtatttttgtgaagttactatcaacttgaacatgcttcttaactgaatccgagaaaggatggctgagaaaatgatcacatacatattccccggacaaggttctcaaaagcagggaatgggaagctcattgtttgatgaatttaaagacttaacggagcaggctgatgaaacactcggatattccatgaaacggctttgtcttgagaatccgtattccaatcttcacaagacgcagttcacccagcctgctttatatgttgtaaacgcgttaagctatttgaaaaaaatccaagaaaatgacataaagccggattatttggccggccacagtttgggagaatataatgcgctgtttgcagcaggtgcttttgattttattaccggcctgcagcttgtccgtaaaagaggcgaattaatgagtatggccactgacggaaaaatggccgccgttatggggttaaccgcagctcaagtgtcggacgcccttcaaacgcacggattacatacgattgatattgccaatatgaattctcctcaccaagttgtcatatccggacgcaaagaagacattgaaagagccaaaagcgtattcgaaggaataaaggacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccagaccttatgagcaagacggaatccactccgttctggccgatcagatcgaccattcagtgcgatggaacgacagcatccgctatctgctggacaaagggcggatggaatttgaagaagtcggcccgggtcatgtgctgacaggacttattcaccgcatcaaaaaagaaactgaagcttcacccgccatgtagcggaatgcaagtcaaaattcttatctcacataatagtgccagccatacaacatcacgaccacttcatctgcacacaacatcaagaaaaacttacaaatcaatattttaaaaaaataaagagcaaaaaggagaacaaatgaaccagccaattgttttcatgttttctggacagggttcccaatactatcaaatggggaaagagctgtttgcacataacgccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagccttggagagtatgcagcggccgctgtgtcgggtgtgctgagcgctgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggaacatatcaaaaagatcatggacgatctgagagaaaagcagattcctcatcagctattgccggtatcttacgggtttcactcagcgctggttgatcaggcggaacagccgtacaagcgctttttagctcagaaatcaatccggactccgtttataccgtacatctccagtgcgaccggagaggctgagaccgatatacaagcggactttttctgggatattgtaagaaagccgattcgattccgcgaagcgcttcaattcgcagacagccgccaaaaaggattgtatatcgatgccgggccttccggaacattggccgcatttgccaaacagattcttcccgcaggatcggctgaacgcatccgtgccattatgacgccgtttcataaagaacaaacccatttgcagcaaatagaagacagcattttatcaccgcccggaaggagactgtaagatgatcagctttgtttttccaggccaaggctcgcaaaaaatagggatgggagaggacctgttcggccgctatcctgaattaaccgcaaaggccgatcacattctcggatattccattcaggagctgtgccgggacggggaacgtctcaatcagactcaattcactcagccggcgctctatgtcgtcaatgccctcagttatttgaaaaaaacagaagaaaccggcttgaaaccggattttaccgccggacacagtttaggcgaatataacgcgttatacgcctcgggcgcttttgattttgaagaaggcctacagctggtcaaaaaaaggggcgacctgatgagccgcgcaaaaggaggcggcatggcagcggtgatcggcctgactcatgagcaggtgacggacgttttaagagagtatcacttgcatacgattgatatcgccaacatgaacactccgcagcaaattgtcatttccggatataaagaagatattgaaaaagccgcatccgtttttgaagccgtaaacggcgtaaaaatggttcaccgcttaaatgtcagcggcgcctttcattccagatacatgctggaagcgaaggaggaattttcacggtttattgaaactttccattttaagccgctgtccattccggtcatttcaaatgtgacggcaagaccttatgagcagaccgagctgaaaaagacactcaccggacaaataacgggatcggtgaactggacagacagcatccgttttttaatgggaagaaagaacatgatctttgaggaaatcggtcccggaaaagtgctgacggggctgattcaaagaattacggctgaagcggagccgataacagatgaaatcaaagtcccggctgaagctggaaaaagctcaattacggcggcgtctttaggaaatgaagagtttaagcgcgattatcaattgaaatacgcctacttggccggcggcatgtaccgcggaatttcttcgaaggaaatggtcgtcaaactggccgaaaaaggaatgatgggctttttcggaacgggcggtttgaacatcgcgcacgttgaggacgccattttgtcaattcagcatgagcttcgtgacggcggttcctttggcataaatgttgtacataacatgaagcatacagattcagaagaaaaaatgattgatcttttactgaagcatggggttcagaacttggaagcatcagcatttttaacggttactcccgctttagtaaggtttcgcgctaaggggttaaaacgcggtgccggcggacaaataatagcgcgtcagcggattatcgcaaagctgtcccgtccggaagtagcggaagcatttctcagcccggcgcctgatcacattctgcagaaacttgcagccgaaaacaaaattaccgctgaagaagcaagtctgatgagagaaatacccgttgcgcatgacatctgcgtagaggctgattcaggcggccacactgacggcggagttgcttacagtctcatgccggcgatcatccgtttacgagatgacatgatgaaaaaataccgatacggcaaaaccgtccgcatcggagccgcagggggaatcggaacgcctgaggctgctatggccgcatttatgctcggcgctgattttattgtgaccggatccattaaccaatgcaccgttgaagcagcgacgagcggcctcgtaaaggatctcctgcagcagatgaatgtacaggacacggcctacgcgccggccggcgatatgtttgaatcaggcagcaaggtgcaggtattaaagaaagggctgttctttccgacccgggcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagctctgcttcggcgattaaaggagacccggatgccaaggtagacttccagattcattgcggcccggcattaggcgcctttaatcaatgggtgaaaggtacggagctggagtcctggaaaaaccgccatgccgatggtatcggccttcgtcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgctgcagaacacaatctacgaggttttgcctgatttagaaggcgaacagctttcaaaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaatgcggcaaagccgattatcgaccgattgacagaggctgaaaaagacagaatcgagctgctgattacctgctcggagtccggcatcgacttcggaaaatcactcagtacatatattcatgattatttaggcctcaaccggaactgccgtttatttgaactgaagcaggcctgttattcaggaacggcgggtttgcagatggcgcttaattttattttgtcgcagacatcccccggagcgaaggcgcttgtcgtcgcgacggatatttcccggtttttaattgccgaaggcggcgatgcgttaagcgaggattggtcttacgccgaaccgagcgccggagcgggtgccgtcgccttattgatcggtgaaaacccaatcgtatttcaggcggatgcgggcgccaacggctattacggctatgaggtgatggatacatgccgtccgatcccggacagtgaagccggtgacgccgacttgtcattgatgtcttatctcgattgctgcgaacagacatttcgcgagtacaaaaaccgtgtgccgggcgctgactataaagagacgtttcactatcttgccttccatacaccgtttggcggcatggtcaaaggagctcaccggacgatgatgcgtaagcttgcaaaaacgaaaaacgctgagatcgaacaggattttcaaaccagggtagagccggggctccgctactgccaaagagtcggaaacattatgggggcagcctctttactggctcttgcaagcacgattgaccaaggggctttcgacacttctaagcggatcggctgtttctcgtacggctccggatgctgttcggaattttacagcggcgttgtgacgcctgaaggacaaacgcggcagcattctttcaaaatagaagagcatctgaacaacagatacaggctgtccatggaagagtatgaagaactgtttaaaggcagcggtctggtgaagttcggaacccggaatgtcaaattggatatgaatatgattccgaacattttagaccatcatgccgggagccctcgtttatatttggaagaaatcacggaatttcatcggaaatacaggtggatgccgtgacctatgagacgatcaacgtccgttttcagcaaaatgtctgcttcatcacctttgatcggcctgaagccaacaatacgattaatgagcgtttagtggaggaatgcctgcacgttctttctgaatgtgaagactccgtgacctccgtagtgcttgaagggcagccggaggtattttgtttcggggcggattttgatgagatgtaccggaaaatgaggcagggaatgcagcatgcggaatcgcaggagccgctttaccgtttgtggctggcattaaaatccgggccgtacatcacaatcgcccgcgtccgcggaaaagtaaatgcgggaggtgtcggttttgccgccgcgtgcgatatcgtcatagcagaggagagtgcttcgttcagtttatctgaactgttattcggactttatccagcctgcgttctgccgtttttaattcaaagaatcggatttcaaaaggcgcattatatgacgattatgacaaagcccgtgccggcgcatcaggcgcttgaatgggggctttgtgacgtatgcgtcccagactcagcaacagagctgagaaagcatttgctgcgtcttcgcccgctgtcgaaaaaagcagtcatccgttataaaaaatacatggattccttaaacgaccttgttcatcgttcgaaatccattgctttagccgaaaatcaagcgatgttttcagatccggataaccaatcagccattttccgttatgcagaaacggggaggcttccttgggaaacggagaacagttaggaggatatcatgccgaacgccgcagttgaactgctcgaaattgaaccggatattatccaagtgacaatgcaggataaagcccataaaaacgccttctccaaagaactgacggatggattgatggaagcattcacccgtataaaaaaatcgtcagtctataaagctgtgattttaacaggatacggccattactttgcttccggaggcacacaggaaggtctgctcaggattcagcagggcatcacgaagtttacggaagaccgcatgtattctttggcgctggaatgtgatatccccgttatttcagccatgcagggccacggaatcggaggcgggtttgtcatggggcttttcagtgattttgtcattttaagcaaagaaagcgtgtataccgcaaactttatgaaatacggtttcactcccggaatgggggctacctttatcgttccggagaagcttggggcaagcctcggccatgaaatgctgttaaacggcggccactaccgcggcggtgacctggagaaaagaggagtgccttttccggtgcttccgcggcaggaagtattagactatgcgcaggaattggcccgtgagcttgcggaaaaaccgagaaactctttaattacattgaaaaggcacttggtgacgccgtttcgcgagcagcttccggccgtcattgagaaggagttaatcatgcacgatgagacgtttcatgatgatgaagtgaaaaaacgaatcacgacgatgtacggagtataagacatacatcttacatacagatgaaatggaggcagctctatgaaaagtgatatgaaggcaagcgggttactcaagccatctgtcagctacggaaaaccattgcggctttcagcggatcagccgatgacgattcctgaagtcctgcacaaaaccgccgcggcagcgggagatcaaaagggcatcacatatatacagcctgacggcaccaaagtgtaccagacttacagcggcctgaaaaagatcgctctttcgattgtgaaagggctccgccaatcaggagtgaaggctcaggatgaagtcatattacagctcagtgataattcccagctgattcctgcgttttggggctgtgtttttttaggagcgatcccggttccgcttgcggccgctccggcttatacagaaatgaacagcgggacgcaaaaactgaaagacgcctggacgcttttgaatcagccgtatgtcatcacaagccgtgaagtgctgccggagatgactgaatgggcggaggagcaggagctttccgggttttgcgctttggcggcagaagatctcagtgcgcatgaaatggatacggactgtcatcatccccgtccggaagatttggcgatgctgcttttgacctcgggaagcacgggcaagccgaaagccgtgatgctcagccatgaaaacatcgtctgcatggtcaaaggaaatattcagatgcagggctatacaagtgaggatgtcacgtttaactggatgccttttgaccatgtcggcggcatcggaatgcttcatctgcgtgatgtttatctcggatgtgaggaaatcaacataccgagcgaatccattttgatggatcctttaaaatggctcgacctgattgatcattaccgcgcttcggtcacgtgggcccccaattttgcctttgggctgcttgccgatttcgcagaagagattcaaacacggaaatgggacttatcttccatgcgttatatgctgaacggcggggaggccgcggtggcgaaagtcggacgcagaattatggagcttttagagccgcatggtctgccggttaatgccatccgtcccgcatggggaatgtccgaaacgtcttcgggcgttattttctcagatgagtttacactggaaaacacgagtgacgacgatcgtttcgtcgagatcggtctgccgatcccggggtttaatatgagaattacggatgaccgcaatcaagtggtggaagaaggagaaatcggccgctttcaagtgtccggtctgactgtaacgagcggatattatgagcgcccggacttaaacgagagtgtctttacagaagacggctggtttgaaacgggagatctcggatttctgcgtgaaggccgcctgacgataacggggcgcacgaaagatgccatcattatcaacggtgtgaattattacagccacgccattgaatcagccgttgaggaattgccggaaattgaaacgtcatatacagcggcatgcgccgtccggccgaatcaaagcacgacagatgagctggcgattttctttgtgacgtctgttccattggatgagaaccgcatgacgaagcttcttcatcacattcaccagcacgtgacacagagaatcggcgttacccctgattatctgcttccggtcgcaaaagaagacattcctaagacggcaatcgggaaaatccagcgcactcagctgaaacattcattcgaacaagggcaatttgattcattacataataacagacaagaaggcggcaattcagccccggcttctgcagagaaagaaattgaacgggattttatccgttttctgaaagaggaactttccatcgcggatgagcttgttgatccaaatacaccgtttcaaagccttggcgtcaattccatcaagatgatgaaactcgccagatcaattgaaaaaacgtatcacatccggctgacggcaagagagctgcacaaaaacccgacgattggcgctttagcggcttatactgctgaaaaagcggcaaacatgtcagcggagcatcattcccaaaaagccgaaccgccggcagaacgggagagacggcaaacggcgccggcgctttcagaagtccaaaaagggctgtggacattgcagaaaatgtcgcctgaaacgactgcataccatgtcccgctctgtttccgattcacatccggaatcgacaaagagaaactgaaacaggcgtttcagctcgtattaaagcagcatccgatgctcaaaagcgccgtgaatgaaacagacggcgggttttatttcatagaagcggcagatccttttgtattctcggaagaagatatttctgacgtcaatgaatcacaaatacccgctctgatacggaaaaaagtgaaagagccgtttgtcaaagaaggcgggcctttgctgcgcgtgcggctgctttcaaaatccgccgcggaacattatcttttgacggtcattcaccacatcgtgtttgacggcatttcatccattacatttattcacagtctgctggatcactatcaggcgctgctggagggaaaagaagagcttacggccgccgtccccggtattcatcccgatttcgcggcttgggaaaagcggtatttagcgggtgaagaaagcaaagctgcccgcgcttactggatgaaacagctcgggggcgatctgcctgaccttcagcttccgccgatgcgcacggacagcagcgttccggagtttacagaagatacgctgacacgccgtcttcccgaacggctgctgaataatctaacggcgtttgccgcatcccgttcgattcatttgtctaccgttatgctgagctgctatatggtgcttttaagcaaatatacggataaggaagatattgtgacaggcatgcctgcaatggtcagacctgaagaacgctttgacggagtggtcggccatttcctcaacatgcttcctatacggagcagagccggacgaaaagaaacatttgctgactttgttcaaaaggtgcaggatgccgttctggacggactggatcactccttttatccgtttccgaaaatggtgcgtgatgtgcatgcgaaacccctgcagaacggttcgcctgttttcagcaatgcctttttctatcagaactttctgcagcattcaagctatcaatcgatgctggatgaatacaaggaattctcctgtgagtttgtaaaagacattcatcaggagggggaatatgatcttgtatttgaaatgtgggaagaagcatcaggcatggatcttacgattaaatacagcaccgaattattcgacgaagcaggggcggccagacttttcagccaatttgtacaggccgctgaagctttgacggcgaatccggatatgccgcttgagaacgtttctctcatgacaaaaagagaggagcacatgattcttaagacttggaatgcgacaagccgtgaatatccggatgcctgcttccatgaattattcgaacgtcaggcggcagaaacgccggacgcttgtgcggtcgtgtatgaacagcaaaagctgacataccgtgagcttgatgaaaaaagcacgaagctggcgctctatttgcaggcgcacggtgcaggccctgatgatctcatcggcatttatacagaccgttcattgcatatggctgtcggccttctcggcattttaaaagccgggggagcgtatgtgccgcttgatccttcttatcccgctgacagattggaatatatggtcgccgacagcaggatttcaatgtgtctgacgacagctgatttagagcactccttgaactggggaggcgtgcagacaactgccattgaccgcgattggtctcgtattgaaagtacagccgcggaaagaacgtcgctgaagcggttagtgacacctgacgatctggcgtacgtcatttacacgtcgggcagcacgggcaaaccgaagggcgtgatgattccgcaccgggcgctgaccaatttcttaatctcgatggcgaatgaaccggggcttacgtccgaagacaaactgcttgccgtcacgacatattgctttgatatcgcggcactggagctttacctccctttaatcaaaggagcagagtgcaacatctgtaagacagaagtcacaaaagacgcacggaagctgaaagagctgattcaagagtacaaaccgacgatcatgcaggcgacgccgtttacgtggaaaatgctctttcattccggatggtcaaatgaagaaaaagtgaaaatcctttgcggcggagaggcgcttagcaaacaattgaagcagcagtttctcgatacgaaaagtgaggcttggaatatgttcgggccgacagagacgacaatctggtccgcggtgcagcgtataacggaaaatgagagcgcgcttacgatcgggcgcccgatcgccaatacccgtgtgtatattatggattccgctctcaaccctgttttagaagggatgccgggagaactttgtattgcgggagacggattggcaagagggtatttcaacaagcctgagctgacagataacgttttcgtcagccaccggctcgaattgggatcaaagctttataaaacaggcgatatggcgcgttttcttcccggcggccgcattgaatacatgggacggatggacacccaagtcaaaatccgcggctaccggattgaacccggagatattgagagccggctgaatgcctatccggccgtacaggaaagcgtggtggttgtgaacaatcactccggaaatgaaaaactttgcgcattttatattctgaaaaacggagagccgcttccgtctgcaaaggaattgcgcaatcatttgaaacaagcgctgccggcctatatgacgccagcttcgtttatccgccttgaagagctgccgctcacaccgaacggaaaagttgaccgcaagcttcttgctgcgcgcgatctgacggaaaagcagccggacacacaaacattttcatcatctcatatccagcaggcggtgctggcgatttggcaggatgtattgaaaagcaaagatatagagcttgatgaccgcttttttgatgcggggggagattcgcttcttgccgtgactgtcactgaccggatgacgcaggaactggattgtgaattcagtgtaacggagctgtttgaatacgcgacggtaaaagacatcagccggtacatcacagaacaaaaactgaaagaaaccgttttggctcctgtgccgcaaaagaaagtgaatacagaagaccgggaacacccagcgggagaaattcccgattattatgaggacagtgtcgcggttatcggtatatcctgtgagtttccgggagcaaaagatcattatgaattttggaataacatcaaagaaggcaaagaaagcatcaccttcttttcaaaagaggagctccgccgatccggtgtttctgaagaactggctgatcatcccggcttcgttccggctaaatcagttttagaggggaaagaaatgtttgatcccggtttcttcggcttttcaccgaaagatgcggaatatatggaccctcagctgagaatgcttttgctccattcatggaaggcaatcgaggatgcgggatatatctcaaaagaaattccggaaacaagcgtgtatatgtctgcaagcacgaactcttaccgcagcctgctgccggaggagacgacagcacagctggaaacgccggatggctacgtatcatgggtgcttgcccaaagcggcacgattccgacgatgatttctcataaactcgggttgaaagggccgagctattttgtccatgccaactgctcatcttcgttaatcggcctgcattcggcttttcaaagcctgcagtccggcgaagccaagtatgcccttgtcggcggtgcgacccttcatacggaatcaagtgccggatatgttcatcagccggggctgaatttttcaagcgacgggcatattaaagcgtttgacgcggctgctgacggaatgatcggcggtgaaggagccggcgccgtgctcttgaaaaaagcgtcggatgccgttaaggacggcgaccatatttatgcgctgctgcgcggaatcggcgtcaataacgacggagcggataaggtcggattttatgcgccgagcgtcaaaggacaggctgaggtcattcagaaggtcattgatcagaccggcatccatcctgaaacgatcgcgtacgtcgaagctcacggcacaggaacaaaactcggcgacccgatcgaactgtccgcacttcaatcggtgtacggccgatatacagataaaaaacaatactgcggcatcggttcagtcaaaacaaatctcgggcatttggatacagcggccggaatggcgggctgcatcaaggttgtcatgagcttatatcatcaggaaatcgcgccgagcatcaattacaaagagccgaacccgaatcttcatttagaagactctccgttttacgtagcgggagaaaagaaagagttaacccgtgagaacagagcgcaccgcatggctttaagctctttcggtcttggcggaacaaacacacacgcgatttttgaacaatatccggatgcatccgaagcagcagacgctgccggtccgttcatcattccgttgtctgccagaaaaaaagatcgtctgaaggagtacgcaaaacagctgctggcttttctggaaagaaaaacggacgccggcctcgctgatcttgcctacacgttccaagtcggaagggaagcgatggaagagcgcgcggcctttatcacaagcggcactgcggagctcaagcggcagcttgccgattttatcaatgataagccggctgtaacaggctgcttcagaggagaaaaacagcaggcaaaagatattgcctggctttctgatgatgatgacagcgctgaactcattgagaaatggcttgcgaaaggaaaaggaacgaagctctgtgaaatgtggagtaaaggtgtcgccattaattggtacaagctttacaaagacaagcatccgaaacggatcagcgtgccggtctacccgtttggaaaggagccgtactggccgaaaaaagcagaaaagaaaacatctgccgcacacaccggagtctcagttttacacccgcttgtgcagcaaaatacgtcagatttggccgttcagcggttcagctcacggtttacaggctcagaatttttcctgaaggatcatgtggtcagggaaaaagcggtgctgccgggagcggcatatttggaaatgtcttatgaagcggtaaaacgggcgcttggcggcttattaaaagaccaagacagaataacgctccatcataccgtctggatgaaaccgatcgtcgttcacgaacaagagcgccaagtccatatcgcgctgtttcctgaagaggacggcatcatctcatatgacatttacagcgtaaacgctgacgatgaagaagtgctgcacagccaaggacgggctgaaatcataaaggctgaacgagagcctgaggccgacctttctgccatacaaaacagatgcacagcggacattcttgatccggcggccttttatcgggaaggccggagcagggggatgttccacggaaaagccttccaaggcattaagtccgcttttatcggcgagaaagaagtgctttcggatatacagcttccggattctgtttctcatacgaacggacaatttacgcttcatccgagcatcattgattcggctattcagacggcgacgatctgcattatgcaggagttttccggacaaaagctgattctgccgtttgcgctggaataccttgaagtcatcaaaccatgcacaccgactatgcgggcgcatgcacgcttcagcgaaggatatcaaaccggtgattccgtgcagaaagccgacattgacctgttcgacgaaacaggagcgctttgcgtgaaggtgagaggattctctacgagagtgcttgaaggcgatgcagaatcggctcagcggccatcaggctcggaaaaggtcttgtttgcaccggtttggaaagaagccgccgcatccgagaaagcttctgtccatgctgatgagcatttgatcatactttgtgaagatgcctgccgtataaaagatgaagcggcatccggcctgaaagacgccgaactgctgattgcagaaggtgagggagaaacagccgctgaacgcttccaaggctacgcgcagacaatcgccgaacacatccggcggatcatcagcgaaaaaaggcagggccgcattctgattcagactgttatttcagcagacggcagccagcaattgtttgcggggttaacaggtttgttaaaaacagccgagctggaatacggaaaacttgactgtcagctcatcgagatggaatcaatcggcgaaatgccggctgccgctcaaaaactgaaaaacgacagccatcggccgcatgataaacatatccgttatacaggagaaaaacggtatgtgaaggcttgggaagaaatgcatcctgcaggtggcggcgccgtctggaaggacgaaggcgtatatctgattaccggaggcgcaggaagcctggggttgatgttcgcaaaagaaatcgctggtcgcgtaaaacacccgaaaatcattctgaccggccgctcaaatctggcagaagccaaacagcgtgagcttgctatgcttcaggactcaggcgcaaatgtcgtctacaaaaagctgaatgcggcagaccggcgggaaaatgaagcgctgataaaagagattacggcggaattcggggagcttaacggaattattcacgcagcgggcgtgatacaagaccgtttcctgctgcaaaaaacgaaggaagagttcagggaagtgcttgatccgaaagtgatcggcaccgcttatttagatgaagccagcaaagactgcaatcttgactttttcgtattgttctccagtgtttccggcgttctcggcaatgtcgggcaggctgattatgccgccggcaacgcgtttatggatgcatacgccgcttacaggcaatcccttacggagaatggcctgcggcacggaaaaacgatcgcctttaactggacgctgtggaaagatggcggtatgcaggcgggagacgagacggaaagaatgatgaaaaaagctttcggcatggttccgcttcaaaaggcgtcaggcctggctgcattttatgaaggaatggctcaggaaaggccgcagcttttagcagctgaaggacacgcagcaaaattaaaacagtcgttcctgtccgtttctgaaactgaaaagccgcaggtggagaaaatagagcctgtatccgccgtttcgggagacaaatggcacggtgcgcttatcagattggtcagttcaattttaaaagtcggccaagacgagattgatattgatacggaactgagtgaatacggttttgattccgtatcctttaccgtctttacgaatcaattaaatgaagcgtatcagctggagctggcaccgacgatcttcttcgagcacgggacgatccgcagtttagcagagtatttgtcggatgaaacagaaagaggtcttccttttcagccggaagaaaaacacgatgcagaagaatctcttcaagcgcttcacaccgctttgacagccatggtaagcagcattttaaaagttgaccgtgaggacattgatacagatacggaactgagtgaatacggttttgattccgtatcctttaccgtctttacgaatcaattaaatgaagcgtatcagctggagctggcgccgacgattttctttgagtacggaacgatcagtaatctcgccggatatttggcaaaagaacatccgggccgtttcggcgaaaagaagaaggagtctccgaaaaaagagcagccaaaagcccaaaaaccgaaaatgcagcggaaaaagcgcttcgcaacggtaatgaacgctagggcagcgacacaagagccgcgccgcttggacccggttgccattgtcggaatcagcggccgattcccgggcgcgaaggatatagaggaattttggcgcaatctgaaagaaggaaaagattctatcacaaccattccgaaagaacgctgggattggcaagcgtttgatggcgacccgaaccttgaaaggaacaaaacgaatatcaagtggggcggctttatcgacggaatagctgaatttgatccgctgttctttgggatttcaccgcgggaagcccaatatttagatccgcagcagcggctgttattgacttatgcatggcgggcgatagaagatgcgggctgtaagccggaaagcctttccggcacaaatacgggtgtctttatcggcaccggaaataccggttataaagatttgttcacaagggcaggtcttgcgccggaaggacatgcggcgacaggcagcatgattccttccatcggtccgaaccgtttaagctatttgttaaatcttcacgggccgagcgagccggttgaaacggcatgttcaagctcgcttgttgcgattcaccgggcggtatccgctatagaaaacggagaatgcgacatggcgattgccgggggaatcaacacgattctgacggaagaagcgcatatcagctacagcaaagcaggcatgctcagcaaagacggaaaatgcaaaaccttctccaaagatgccaacgggtatgtcagaggagaaggcgcgggaattctgatgctgaagaaactgacagatgcagaacgtgacggcaatccgatttacggcgtgatccgcggtacggctgaaaaccacggcggccgggcgaatacgttaacctcgccgaatccgaaactgcaggctgatttattggtgaaagcatatcggaaagcgggagtggacccgagcaccgtcacgtatattgaagcgcacggtacaggaacggaattgggcgacccgattgaaataaacggtttgaaagcggcgtttcacgagctggcgaaaacaaatcaagagcctgaagtctccgatcaccgctgcggcatcggttcggtcaagagcaatatcggccatttagagcttgccgcgggagtatcaggcgtcatgaaagtgcttttgcaaatgaagcacaaaacgctggtgaaaagcctgcattgcgagacgatcaatccgtacattcagctcgatgacagtcctttctacatcgtgcgggaaaatcaggaatggacggcagcgaaagatagaaacggaaatgcgattccgcgccgggccggggtcagctcatttggcatcggcggggtcaacgcccatatcgtcattgaagagtatgtcccgaaagcagccgcgcagcctgagcacagcccggaaaatccggcaatcatccttttgtccgccaaatcaaaagaaaaactgtttgaacaggcgcagcagctgcaaaaagcgatccgtcaaacgccgtatacagatcaagacttggcgggcgtcgcttatacgctgcaaaccggaagggacgaaatggaagagcgcctggccattcttgcagcgacgatggcggaattggaaacaaagctggaagcatttacgaaaaatgagaaaaacatcgccgggctgtataccggccagtctcaccgcaataaagatacgtttgccttgttcacggcagatgaagatatggacatcgtcattgacgcctggattaaaaaaggaaaattcgccaagctggcagaggtatgggtgaaaggcggcgtgttgaattggaaccggctgtatgaaaagggcacgccgcgtttactcagtcttccgtcttatccgttcgcaaaagacacgtattgggtgcctgagaatcctgacaaaaataaggtccatacagaggaacggatgaaacgtattctgacaaaacaatgggaaccgagcccgctcgaactgcgtgaaccgtgcccacgttccgttgcgattttgacaggcggggacacgatcaatctcgcagaagagatcgcagcgcatatgccgaatcaccgtattatcacaacatcagaccttaccggtgaatatgactggcaggcgtttggcggagtcatcgaccttctcggcgcagcgaaagaagaagcttctggagatatgcccggtatcaaatggcttcagcaattgattgagcatgggcataaagaagggataacactgctttgtgtcacgaaagaccttgagtcaatggggaaaaaggccaatcaaataacgggagcaaaacgggccgggctgtacagaatgctggcatgcgagtacagtcatctgtcttcaaggcatctcgaccttgaaggagcgctttcggatgacaaactggcgaagcagattgccgatgagtttcatgcccgtactgatgacgcggaagtttgccggagggacggcttgcgctaccgcgccgtattgagcggatcagaaaatatgaatacgcaaggcgagagaattgattttccggaccaccatgtgcttctgatcaccggagggacgagagggatcggccttttatgcgcacgccattttgccgaacattacggagtgaaaaaactggtgcttacaggccgtgagacccttccgccgcgaagtgagtggacgggcggactgaatggggtgacggcttctgtaaaagcgaaaattgaagctgttctcgacttggagtccaaaggtgtacaagtgaaggtattgtcagtcccgttagctgatgaagccgggctgagacaggaattgagtcagatcaaacagatgctcggacctatcggcggcgtgattcactgcgcgggtgtgaccgataaagagacgctcgcattcatcagaaaaaccgatgaagacatacagcgcgtgctcgagccgaaagtagaggggcttcaggcgttatacagtgtgctcagcgaagagccgctgaagtttttcgtcttgttctcttccgtgtcagctgcgataccggcgctttcggcaggacaggccgactatgccatggccaatgcgtatatggactattttgcagactcatacaaagagcagctgccgatcgtaagcattcagtggccgaactggaaagaaaccggaatgggcgaagtaacaaacaaagcttataaagagagcgggctatacagcatcacgaatgcagaagggttacagctccttgacggcatacttcttgaatcagcaaggggcccggtgctgccggccgttctgaatcctaagctgtggaaaccggagcgattcctgcggcggagcaggcaggatcagccaatgagtccggctatggtaaaatcggcggaaaaaaccgctgataccgccgcagacaacgctcaattaacaaggaaaacagaagaatggctgaaagaattattttctgaagagctgcggattgaccaggatcagcttgagacagacgtattattccaagattacggagtggactccattatccttgctcagcttctgcagcggatcaatcggaatctctcggcatcgcttgacccgtccattctgtatgaatatccgacgattcaatctttcgcaaaatggcttctcgaaggatatacagaagttttgtcagaacggtttgatttggcggcggctgagcctgttatgaagaagccggctgagccggtaattgtaacacaagccgttaaggtgcaagaagaggcggccgaaaaacagattcaccgggaagatatcgcggtcgtcggcatgtcctgccggtttccgggggcggcttccttagaggcgtactggtcgcttttggctgaaggccgttcggctatcggtcctgttccggctgagcgatgggggttgaagacgccttattacgcgggaatgcttgatggaattcatcaatttgatccggacttctttttactggctgaagaagatgtaaaggcaatggaccctcaagctttggccgctctggaagaatgtcttaacctgtggtatcacgcgggctatacgccggatgagataaagggagaagcaataggtgtgtacctcggcggacgcagccgtcacagaccgggtgaagagaaactgctggatgcgaaaaacccgatcgtcgcgctgggccagaattatttggccgccaatctctctcaatattttgatatgcgcggcccgagtgttgtcctcgatacggcttgttcttctgctttagtcggaatgaatatggccgtgcaggctcttgtaacaggagaaataaaagcggccgtcgtcggcggcgtgagcctgtttgaatcagaagaaacccataaattatttgaacagcgcggcatattaagtaaagcgcagtcgttccatgtatttgacgaacgcgccgatggagtcgtgctgggcgagggagtcggaatggttcttttaaaaaccgtgtctcaggccattgcagacggagattctatttatgccgtagtgaaggcggcatccgtcaataatgacggaagaacggcaggcccggctacgccgagtctggaagcgcaaaaatccgtcatgaagacggctcttgaaaaaagcggaaaacagccggaagacattactcatattgaagcgaacggttcaggcacggtcgtgacggatctgttagaactgaaggccattcaatccgtctaccgttcaaaagacgccggcccgctcggaatcggatctgtgaaaccgaacatcgggcacccgctttgcgcggaaggaattgcaagtttcataaaggttgttctcatgctgaaagaaaagagctttatcccgtttttatcaggtgagcatgaaaacacacattttgatagagaaaaggccaatattcagttcagccgcactctggcagactggccgtcaccaataccggcggcaggaattaactgctttgccgacggcggaacaaacgcccacgtcattgtggaagcgtggcaagaagacgaagggcgccgaatcaagcgccaccctttaacaccgcctgcattaaataagcggctgatttcgccggacagcaaagacgaaaaagctgcggcaaacatctgggatacctatgaagtggaggtttaacgtgaagaacttcaataagcaaatcactttatcgctgaaaaatccgtttattttacatcatgacgtttacggacaaaaagtccttccgggattggcttatattgatatgttttatcagattttcaaagagcgcggctattcatacgacgggcttcagctgcgccatttatccatatatcagccgcttatcgcgaaagaagacagcgccgtcaagcttacggttgaatgtacaaaggtaaaagaagggcgctggaaacttaccgcaaaaggggctgaggtcagcggcggacgagtccagccggaagaacgtatttacgtcaaagcggaaatgcacgagacggcacccgcagttttcagtgacacgcttgatcttgactctgtcaaacgcgaggcggaacgcaccatcgatttaaatgagctgtatgcccaatgcagaagccaggaattggttcacagcggatatatgaaagcggaaggagaagtgtttgaggagcgggacggcgtcacctttgatgtatcgctcggaaaagacgcgatgggacaggccgaagggtttttgttccatccgactcttcttgacggaagcggcgtcggcgcaaacctattgatctcctcgctgttaaatggggaaaagaggctgtttctgcctcttttctacgaatcttttacagcttccgaacctttgcaggccggctgcatcacgagaatcaaacgttcgtcgcttcggcaggaaaaagagctcatttacattacactggagttttttaacacatccggccgaaaagtagccgagctgaaagatttcacaagcaagctcgtgcgggatgccgagctgatcaatacagaccgaaagactgctgagaagtctcctgaaaaagccggtttaccggaagttgcggcatcgcttgaaggcggacacccgcatgaggaagcagaacggtttgtcatgaatctgatggctgaaaaaatcggcaagccgcttgaacagattgattcacaagtcggctactatgaaatggggctgacatcgtccggactgcttgacgtcgtcgaaacgatcagcgaaaaaatcggcgaaaccctttctccgactttgctgtttgaatatacgacggcatcagagctggcggctttcctgacagagcagtacggaagccatttcagcgcgtctcctgcaaaaatagagaagcaggttgagaagcaaacagaaagaagacggaaaagcagtgttccgcaagatgaagatatcgcgattatcggcatggccggccgctatccgcaggccgaaaatattcatgaattctgggaaaacctgaaagaaggaaaaaactgtgtcaccgaaattccggagtctcgctgggactggcgccggtttgaaaatgtaaagtcgccttccggaaagagcatttcaaaatggggcggatttattgatgatccggattgctttgatccccaatttttccggattacgccgcgggaagctgaaacaatggaccctcaggaacggctgtttttacaaacatgctgggaaacgattgaggatgccggatatacgccgaagtcgctcgcagaggcgcgcggacggaataagagacagcgcgtcggcgtcttcgcgggggtgatgcataaggattatacgttggtcggggcggaagcttcttctgaagatcatgtattcccgctttctcttaattatgcgcaaatcgcaaacagagtttcatatttttgcaattttcacgggccgagcatggcggtcgatacggtctgttcatcttcgctgactgcggttcaccttgctgcggaaagcattcggcgcggggaatgtgaatcggcggttgccggaggggtcaacttgtcgctgcatccgaataaatatctgacatacggtttatgggacatgttttcaacagacggggtttgtcatacattcgggaaagacggagacggctatgtacctgctgaaggaatcggtgccgttttattaaaaccgctgcgagaggcggtaaaagacggagaccggatttatgcggtgataaagggcagtgccgtcaaccacgtggggacagtgagcggaatttccgtgccgagtcctgtcgcgcaggccgatttgattgaagaatgcctggacaaagcgggcatcgatccgcgcacggtcagttatattgaggcgcacgggacgggaacttctctcggcgatccgattgaggttcaaggccttgtcaaggcgttccgccagtacacacaggacaaacagttctgttcgatcggatcagtgaagtccaatatcggccatgcggaatcggcggcgggcatcagcggcttaagcaaagttgccctgcagcttcaccataaaactttggtgccgtctcttcattccgaggagctgaatccgtatttagattttgaacaatcaccgttttacgtccagcatcataccgaagcatggcagcagccatcagtgacggaaaacggaaacgagaccgtatatccccggcgtgcgggcatcagttctttcggggcgacaggttcaaacgtgcatctcattctggaggaatttatccctgaagaatcacagagaacagcgtatgaaccggcagaagaacagactttcattttcccggtttccgcccggaatgaagaacggctaaaagagtatgttgcgaagctgtcttcatttatttatcccggcctgccgcttgaggatgcggcgtatacacttcagatcggccgtgaacagatggaggagcgggttgcgttcaccgctcagaatatgacacagctcaaagagcggctggaaggctttctggcgggtaaaacggtcagcggatgctggcggaaccgagccgataaaagcaatcaggcagagcttgctccggacttgatacataaatggctttcttccgggagtctggagatgattgccgaaaagtggaccggcggaggaacgatggattggaatctcttgtacggtgaaaacaaaccgaatcggatcagcctgccgacatatccgtttgaaaaaatccggtattgggtgccgaaggcggagaaaagagaatcgctgccgcaaaaaagggcaggcatgctgcatccgctccttcatgaaaatgtatcaaacatgtcaggtgttcgtttccggtcctcttttagcggcggagaatttttcctgaaagatcacgtcgtcaaaaacgagcggacgttaccgggcgcggcttatctggaaatggtccgggcggccgttgaacacgcggcagaaacgaaggaagaaggaacagtcagtctgaaacatgtcgtatggatacgtccgtttacagcggcggatgaatccgcagaactgtatctccgtctttatgatgaagaaaatggggagatgggcttcacggtttacggtgaatcggcttcctcggaacaagagcccgttctctatgcgcaaggaagcgcggcgtttgtccgagggggcgaaccggccaaaatcgagattgacaaattaagagagtcacgccgtctgatcacacctgacgcttgctatcaggcatacaaacagatggggattgaatacggggatgctcacaaagcggtcacggaaatctatgcaaaagacagcaaagtgctcgcgaagctctcactcccgtcatctatttctcatacaaaagatcagtttgtcctccatccgagccttttggatgcggctttccacgcgacaatcgggttaatgcttgacagagacgggagtgacataaggccgatgctgccgtttgctctcgaacagattgatgtgttgaaaagctgtaaaagcgatatgtgggtttccattgcgtacagcggcgaaagcaagccagaagatgccgtgcagaagctggatattgatgtatgtgacgaacaaggcaatgtatgtgtgaaaatgactggttattccgcacgggaaattgaaacggataaaacagatacactattttttgaacacgtatgggaagagaaggccgctgtacatgaaaaagcgccgactcatttcaaagcccgtcacgtgatgatatcagaccggtttacggatcaaatgaacagcatacagacagacttcagctgtcacgtgctccgtgatcagcataagagtgaagacgaacggtttgaagcttgtgcgcttcaggcgttcgaagaagtgaagaaaattctcgcttcaaattccggcgggcgcgagctcattcagattgtcgtgcctcaagaagcggatacgcagctcctttgcggcttaacggggcttttgaaaacagcggcgcttgaaaacccgaacctgaccggccagctgattgaattggagccggacgtcaaggcagacacgctgtcccgatatgtaaaagaatgcagcgctcatcctgatgacaaacatattcgctatgaaaacggcaagcgctatacggcacaatggcaggaaacagggcttgaacagttcggcgccgaaaagccgtggaaggataaaggtgtttatctgatcacaggcggtgcgggcggactcggatttttattcgccaaagaaatcgcccggcatgcaaaagacgccgtgcttattttaacggggcgttctctgttggataaccgtaaaaaagaccagctgcaagaactgtccgatctcggcgcgcaagccgtgtacaaacaaacggacatgacggaaaaacaagaagttcaatcgctcacagcggacatctgccggcagtacggcggattaaacggtatcatacacagcgcgggaatgataaaagacaattatattctgaaaaagcacaaagatgaaatccgtgatgtactggcgccgaaagtctccggactggttcatcttgatgaagcggcaaaggacattgagcttgattttctgattcttttctcttccggagccggaagcgccggaagcgcgggacaggctgattatgcgatggccaatgcgtttatgaacgccttcagtgaaaaaagaaaccgtaaaaaagcccgaaatgaacgctatggacacaccctttcaatctgctggccgctttggaaagacggcggcatgacggttgacgctgaaacggaagcgatgctgacaaaagaaagcggcatggtccctatgaaaacagaaaacggcatccatgctttgtaccgcgggtgggcggcaaacacatcccaaatcatggtgacggaaggctacgccgcaaaaatccgggcgtttctgaaaaaatcagcggatgatcagccggataagggcagcgaaacggaagaaccggcaggtcttacggcaggcggagagaacatgcttgcagaaaaaacggagcatttcttgaaacatgtgctttcggaagtaaccaaacttcctgtcggcaaaattgacgccaaggcgcctatggaagattacggaattgattcgattatgattatgcatttgacgggccggctggaaaagagcttcggttcattgtcaaaaacattgtttttcgaatatcagaatatcgaatcgctggcgcagtattttatgaaagcacaccgggacacgctgctggaagtgaccgggctgaaaacagaagaaacctctgcagccaaaccgctgtctgagaaagccgaaataaagcccgtttccaaacggaatgaaggcaaaaaaggctttgcgcaagtccgcacagacacgcggaaaaatccagtgacggagcgtgaagatatcgcgattatcggtatatcaggacgatatccgcaagccgaaaatcttcaggaattttggaagaacttgagtgaaggcactgactgcataactgaaattccaaacgatcgctgggatcacagtctttattacgacgctgataaagataaagaaggcaagacgtacggaaaatggggaggatttttgaaagacgtggacaaatttgatccgcaattcttctctatttcgcctcgggatgcaaaattgatggacccgcaggagcggttattcctgcaatgtgtctacgaaacgatggaagatgccggttacacgcgcaaaaagctcacggaaaaatcgggtgatttgcttggcgccaatgtcggtgtttacgtaggcgtcatgtatgaggaatatcagctttacggagccgaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagcggtactccttaagccgctttctaaagcgaaagcggacggtgatcatatttacggcctgatcaaaggaacggccgtaaaccatgatggaaaaacaaacgggtattccgtaccgaatccgaacgcccaagccgcggtaatcaaacaggcgttaaaagacgtgggaaccgatccgagggcggtcagctacatcgaagcccacggcaccgggacttcactcggtgatccgattgaaatcacgggtctgacaaaagccttttcagaacaaacacaagataaacagttttgtgccatcggctcagcaaaatccaatatcgggcactgtgaaagcgcggcgggcatcgcgggtctgacgaaggtgctcctgcaaatgaaacataagaaactcgcaccgtcactgcattcccggacgcttaacccgaatattgattttctcgctacgccgtttaaagtgcagcagacgcttgaagagtggaaaagaccggtcataaatgaaaacggaataaataaagaactgccgagaaccgcggggctttcctcattcggagccgggggcgtcaacgctcatatcgtcatcgaagaatataccgctgatgaggataaggagacggcttttgccgctcctcatccgtcgatgatcgtcctttccgcgaaaaatgaacaaaggcttcaaaaacgggcggaacgtcttcttgatgcgctgcggagcgggcgttaccaagaagcggatctgagccggatcgcatatacgcttcaaatcggacgtgaaccgatggaagagcgtctcggaatgattgtcagcaatttgcgcgagcttgaagaaaagcttgacgaatttacgggcggcaaggagtcaattgaccggctctaccgcggacaagtcaaacagaataaagacacgatggcgctgtttgcggctgatgaggacatggaaaaaaccattgaggcatggcttgaaaaaggcaaagccgcaaaggtattagagctttgggtgaagggccttccgctgaattgggataagctgtatcaaatgggcagaccgcaaaaaatcagtctcccggcctacccgtttgcaaaagaccgttattggatcgacacatcagctgatgcagctgtcaaaagaccggccgaaacacagtctgcgccgatcgcaccggcggccgtcccggaaccggtcattgaagtagcaactcttcacgaggagactgccaaagaaaaaccgtcaaacatttcattgcagcctttgagcggcgcgaaaccgaaaagaaccgtacagtctgcttcccgtccggcggtatccgctgaaaaagtaagtgccgaattaacggaaaggttggcggacgtgttatatatggatgccgacgatatcgacgcagatgacacatttattgatatcggcatggattcaatcacaggtcttgaatggataaaggccgttaataaagcgtacggcacgtcccttacggtgacgaaagtatatgattatccgacaatccgccagtttgcggccttcttgcaaaaagaactcgggacagaaccgatccttgaggaagcagccgaaccgcagaaaacagaggccgtaaaaaaaccgtcaaacatactgctgcagcctttaaacgctcataagcagcatgtgatacaagcagaagcggatattctggaggcgatgtctgaaacggcagcttccgccgaaccggaagaaccgattgaagcggtgcatgacgagttatcaaaagcactggctgatgtattgtacatggagcggcatgaagtggatattgatgaggcctttattgacctcggtatggattcgattaccggtcttgaatggataaaggtcgtcaataaacggtacggcacggactgtaacgtaacgaaagtgtatgattatccgacaatccgtcaatttgccgattttctgcgtacgcagccgtccgtccgcggcagaaaaaaacaggcggttcccgtacgtccaaagccgcttacacagcaagccgccccgcaggagaaaacacctgccgagccggagagattaacggttcaaaaggaacctgaaccggtgcaggccaaacgggagcctaaagacgagatagcggacgcgatagccatcgtcggcatgtcgggaaagtacccggatgcgccggacctaaagacatattgggacaacttagcccgtgcgaaaaacgccattcgcgacatcccgctttcccgctgggatgtaaacaaatactatgatccggccttaaacaagaagggcaaagtatactgcagatcaatcggtatgcttgacggcattgaagagtttgatccgctgttctttaatatttctccgtctgaagcggaacttatggacccgcagcaccggatatttttacaggaaggttttaaagcctttgaagatgcgggttacagctcaaaagaattaaacggaaaaaattgcggcgtttatttggggattatgaacaatgaatacggaatgatgttaaacaaacatcagacaggaggaagcgcgacgggcaacagtttcagcatcgcggcggcccgcctgccttattatctcaatttgaaagggccggccattccgatcgatacggcatgctcttcatctctcgtcgggactcatttggcgcgtcaggcgctgttgaatcatgaaattgacatggcccttgtcggcggcgtcaccttgtatttaacgcctgaatcatacatcagcatgtgtgaagccggaatgctgtctcctgacggccaatgtaaagcatttgataacagtgcgaacggatttgtgcctggcgaaggcgcgggggcgctcgttttgaagaggctgaaagatgcggaagccgatcaagaccatatttacggagtcattatcggatctggaattaaccaagacggaaaaaccaacggcattaccgcaccaagcgcgaaaagccaaatggatttagagcgtcaagtgtatgaagcgcacaacatccaccctgagagcatcacctatgcggaaatgcacggaaccggcacaaagcagggggatccgattgaattagaagccttatcttctgtattcaaggaaaaaacggaccgcaaacaattttgcgccatcggttcggttaaatcgaatatcgggcatacgtcggcggcggcaggtgtagcaagcgtccagaaggttctgctgtcgatgaagcaccagcagcttgtgccgacccttcatttcagcacgccgaatgaacattttgatttcgatgactcgcctttatttgtcaataccgaactcaaaccttgggaaacaggcggagcaccgcggcgggcctgcgtcagctcattcggctacagcggcacaaacgctcatctcgttatcgaagagtatcagccgaaagaccggggaagccgcaagtctgatgagacaaacatttttgtgctgtcggcgaaaaaagcgccgcaggtaaaaacctatgctgagtctgtgatcgaatttgcaaaagccaatcagaatatcaatctttcggatatggcatacacgcttcagaccgggcgtgatgcgatggattaccgtcttgcggttacagccggttcgagagaagaactgatcagccgtttaaccgattttgtaaacggaaatacgggtgaagggatatatgaagcccacatcaaaacggcaaaaaaagaaatcaaagcatttgaaacggacgatgatctgaagcagcttgtcaggtcatggttcgataagaaaaaatacgccaaaatagcggaattgtgggccaaagggcttcagacggactgggacagactctatcaaggcgaaaaaccccgcagaatcagtctgccggcttacccatttgcgaaggagccgtactggctgcctgagccgaaagccgtaccgcaggaaacagaagaccggcgcaaggctgtgcttttagaaaagcaatgggttccgtgtgagatcgattcggccggtgagaaaagcggcaggacggtcatgattctggctgatgcaagaacagcggaacttgccgaagagactgcgaagcatttcgctgactcgttcattctcccggccgctgacgctgacactgcagctagcgattggaatcacatagatggcgtaatcgatctgacgggatgcggagacgaagacccttcactggaagggatcagccggctccagactctgattgatacaagccgccggcaagcgcggccgctgacgctgctatatgtaacaaaaggcttggagccatttcagcagaaaacgattcatcttgcaggagcggcaaaaagcggcctgtacagaatgcttcaaaatgagtatcaaaacgtgacgtccagacacatggatgccgatacagatacggatcagcagacgcttgccaaacagattgcagatgaattttcggcggacagcacagaaccggaagtctgccgccgaaacggacaaagataccgtgctttgttcagcgagattccaagcgggaagcgagcagaacataagccagcaccgtttcctgaagaccatgtgcttttcattaccggagggacgaggggactgggtctcttatgcgcccgccatttcacagaaaaacacggcgtgaaaaaagtagtgctgacaggcagggagcctattcctccccgtcataaacggtcagccgttaatacgaggctgagagagaagatacgggcgattgaagagcttgaagcaaaaggagtgcaagtggcggtgatcagtctgaaattgtctgatcatgatgcggcggcagcggaaattgaaacgatccggcgcacgatgggaccgatcggcggcgtcattcactgtgcgggatcggttaattcagtaaatccggcgtttatcagaaagactgccgacgacatacaagaagtgcttgaaccgaaagtcgccgggcttcaaacattaagcagccttttcacaaatgatcctttgcaattttttgtcttattttcttcagtatctgcagtcgttccggcgctcgcggcgggacagtcggattatgcgatggcaaatgcgtacatggattatttcgcggcggctcatcagcatcaatatccgttagtcagcattcaatggccgaactggaaggaaaccggattgggtgaagtccgcacagaaaacctgaagcagaccgggctgctgggactgtccaacgcggaaggacttgacttgctggaccgcattttatctgaaaacatccgcccgtccgttctgccggctatcgttgatcggagcgaatggcatcccgacaggctgctctgtcaagagaaaaaacaaaaagagtctgaagccgtaataaacggcaaagccgcggacaaacaatcagacagagaactgcttcttgatacgaaggcgtggcttgtgaaattgttttccgatgagctgaaaatcgctccggatgaactggaaacagacgaaccgtttcaggattacggggttgattcgatcattttagcgcagcttttacagcaaatgaatcaagcgctcaaagaggatttagatccgtctgttttatatgaacatccgacgattgacgcgtttgccgaatggcttgtatccaatgggcaggcgctgcttgcagaaagggaggaacctgatacggaaatcttggttccggctgccgtacaaacggttcacactgagcaaaagcgtgctgccgtaactgaagacattgccgtcgtcggaatgagctgccgttttccgggagcggaatcgttagaacaatattgggacttgctgagaagcggcaggtccgcaatcggctccgtcccggcggaacgtttcggatatgcaaatcaatatgttgcgggattgattgacaatatggatcactttgattccgaattctttttcattccggaaaacgacgcgaaagcgatggaccctcaggcgttggcggtgctggaagagagcttgaaactttggtgccatgccggctataaccgtgaagaaatcaagggcatagaggccggtgtgtatatcggaggccgcagccagcatcagcctgatcctgaaagtcttgcgaatacccgcaacccgattgttgcgggcgggcagaattatttagcggcaaacgtttcgcaattttttgatctgcgcgggccgagtatcgtgcttgatacggcttgttcatcagctttgacaggaatgaacatggccgttcaggcactgagaagcggcgatatcaaagcggcggtagttggcggcgtcagcctgctgaacacagatgcggcgcaccggatgttccaagagcgcgggctgttaaacgagaaaccggcatttcacgtatttgacaagcgttcaggcggagtggtcctcggtgaaggcgtcggcatggtgctgttaaaaacagtaagccaggcgcaaaaagacggcgatacgatacacgcggtcattaaggctaccgccatgaacaatgacggcagaacggcaggcccgtcagccccgaatatgcaggcgcaaaagaacgttatgcaaagcgcgcttctcaaaagcggcaaaaagccggaagacatcacttatatcgaagcaaacggatcgggttccgcggtgactgatttgcttgagctgaaggcgattcaatccgtataccgctcaggtcagcatgttccgctcggcatcgggtcaatcaagccgaacatcgggcatccgctttgcgcagaaggcattgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaacctgacgtacgagcggagaaacaagagcttcctgcgaaaaaaatgttttggaaagcatttaaataagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagcttgaattgaagcacgttacgatttatcagcctttaaccgtcagtgaaacggctgcaatcattctgaccattcaatgttctgatagcggagatggaaagtggctcatctccctttcagggcagaaacagcaaggtgacgaactgtcagacaatatacaatatgcgacggctgaaatggtgaaaagagacgctgtcacatttgacgaaaccattgatttcggcgatgtgaagcagtcaggcagatctctgaatcttgatgacatgtataaccgctgcctgaatcatgacttggttcattccggcatgatgaaatcgaacggacgattgtacgaaacagaaggcggcatgctggctgagctttcttgcgaagaaggaaaagatttctttttattccatccggcccttttggatgcgagcggaatcggggggagcggtttgctttcagaaacaaaccggcttcacctgcctttatattatgaatcgttcacggccgctgacaggcttcaatcagagtgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagaagacgcgaatacagccgaacagaatcaacaggctgcagctgagccggaaagcgcagatgaaaaagacatcattctgtttttaaagaagcttttggctgataagcttgggcagccttgggagacgctggacgttcttgcaggctactacgagcttggactggattcatcttctttgcttgagattgtacaggatatcagtaaaaagacgggtgcggacctcgcgcccactcttctctttgaatatacaaatataaaagaactcgcagcctatctgaaaaagactggttcatttgaatatgcggaggaacgtgcagccgaatcatcacggtctgaagctgaagcgccggacgcgccagaacatcataaaaacaccggagacatcgcgattatcggaatggccggccgctatccgaaagcgaaaagtgtggcggagttttgggaaaaccttaaggcaggcacggattgcatcactgaagttccgaagtcccgatgggattggaaaacatatcaaaacgtaacgtccccgtctggaaaaacagtatcaaaatggggcggtttcattgacgatgccgactgtttcgatccgcagtttttcagaatctcaccgcgtgaggcggaaacgatggatccgcaggagcgcctgtttttagaaacatgctgggaaacgattgaagatgcggggtatacgcctgaaacgctggggaataaaggggagaaacagcatccgatcggcgtatttgcaggggtgatgcataaagattattccttaatcggcgcagaacaattatctgaagctgatccttttccggtttcactgaattatgcgcagatcgccaacagagtgtcctattattgtgacttccacgggccgagcatcgcggtggataccgtttgttcctcatcattgaccgccgttcatctggccattgaaagcatccgccgcggcgaatgtgaagccgcgcttgcgggaggggtgaacttgtcgctgcacccggcgaaatatctcagctacggaagcgtagggatgcactcaagtgacggccgctgccgcacattcggcgagggcggggacggctacgtttccggagaaggtgtcggtgcggtcttgctcaagccgctggaaaaagccgaacaagacggcgaccgcatttacgcggtcattaaaggaagcgccgttaaccacgtcgggaaagtaagcggaattaccgtcccgagtcctgctgcacaggcagaagtcattaaggcctgtctgaaaaaagcaggtatcagcccgcggaccgtcagttatgtggaagcccatggcacgggtacttcgttaggagacccgattgaaattgaaggtctgtcaaaagcgttcagccaagggacgcaggatcagcaattttgttccatcggttcggtcaaatcaaatatcggtcacgcagaatcagcggcggggatcagcgggttaacaaaagcggcgctgcagcttcatcacaaaacgcttgtcaaatcactgcattctgcggaattaaatccttacctgaaatttgagggatctcctttttacgtacagcagcagactgctccgtggaagcagccggcagccgaagaaaacggaaaagtcacacattatccgcgccgggccggactcagttccttcggtgcatcaggctcgaacgcccatatcattttagaagaatacattcagcctgaacaaaaagcgcctgcacctgagaacaatgcagcaaaactcatcccgctgtcagcaagaaataaagacaggcttctggcctatgcggaaaaactagcccgatcgctttcagaaaagacggtgctgtctgaactggcttatatacttcagacaggacgtgaagcaatggaggagagagctgtcttccttgtaaatgacacccgcgacttgaaagaaaagctgaatgatttcgtaaaaggaaacgaaaacatccccggtctttggcgcggacaagccgagctgccggaactgagcgaaaccgctcccgagacggatgatccgatacggcttgccgagttatgggcagaagggaaaataatagattggaataagctgtacgcttcgggtaaaccgcgtaaaacaagcgttccgacgtatccgtttgcaaaagaacgctattggattccgcagcagaaaaaacaggagaaaagcccgtcaggcacagtgctgcatccgcttttacaagaaaacacgtcagatttttcgcagcagcgcttcacgtctctttttactggagatgaatttttcctatctgaccatgtcgtcaacggacaaaaaatactgccgggcgttgcctatttggaaatggccagagaggcggttaaaaaggctgctgccgtgacggaaaaagaccatagcgtcacactcaggcaggttgtttgggtccggccggtcatgattgaagacaaaccgaaggaaatacatattgccctttacccagaagataatggtgagattacctatgaaatatacagtgaggcagaaaacggcgaagatccggttattcacagccagggtgaagcggtcattaccgaaccgggaagcgcccagattgatatcgagtctgtcaaagcttcctgcaattcagggaccgtgactgcggaagaatgttacggtgcttttgagaagatcggtctggattacggagaggcatacagaggcgtacagcgattgctgatcggagaagaccgattattggcccgtatttcactcccggctgccgtacatgacaataaagaacagtatacgcttcacccgagtatgatggacgccgcttttcacgcctcagtcggtctgcttgtccgctcaatacatgacgatgcagacagccacgagctttctctgccgtttgcgatgcaggaagtggaagtgttcgggccgtgtcctgaacatatctggtcatatatccggtacacagaaggcagcaaagcagatgacaacgtaagaaaatttgacattgatatgtgcgatgatgccggtacggtttatgtccggatgaaaggcgcgtccgtccgggcgcttgacacaggccaaacagcgggcggagaaaccccggaagcgcctgtcggccatacgatgctgattccggcatgggagcccgttgcacttgaaaaaacgaagaaagcaaaaacagcggaaaagcagactgcggttttcggtgaaactgacagaacgcatacgcgcataaaagaacatctgccgaacgcttcctattatccgatcagaggtacggatgatatcacatctcttacgtacatgcttgaaggacaaaaagagctggagcaaatcatttggcttgctccgcaggctgagagtgcttgcagcctcaaggaacaggaaagaaacgttcttcatgtgttcaagctgatgaaagcattacttgccttggggtacggagaaaaacatttggactggtgcatcgtcacagcaaatgcccagccgtt

SEQ ID NO: 113 - DNA, 132403 bp, Bacillus velezensis FL50S
tagaaggccgttgctctatccagctgagctactgggacagcttttgctttatgtatcagcgacaagatttattatatacaggttcaaatcataagtcaatatttttttaaaaacttttgatggggaagaatgaaatctcccccatcacttgttaaaaactgattgtattccccaagtccttcaattcccgacccgtttcgtcgtaaaatgtcacggcgccttctctttctgtaagagtaagaatggcatagcttttcacattgcggactctcggaagacggatgctgcccggattaatcaaaagcttgccccgaagcacttcactccccgcaatatgtgaatggccgaagcagacgatatccgccccaagctcttccgcccggtaaaaaacagttaaaagtgactgtttaatgccgtgaagatgcccgtgaacggccagaattttctttgaaccggcatccagaaggagttcatcctgaaacccgccgccaaagtcgcaattgcctttcaccttgtgatacggcgtgagtgccggatgtgcggcgtcaagctctgaatcaccgcaatgaatcatcagatccgcttcgtcttcgtgccgctttgcaatcgtctccagctcgtcttcaaggccgtgactgtcacttattatcagcactttcattgcatacgctcccccttatgaatcaagcagctttgacagtttcttgagcgcctcagccctgtggctgattttgtttttctcagcgcttgtcagctgggccatggttttatctttatcttttacaataaaaatgggatcatagccgaacccgttatctccttcgggtccttctgcaatatacccttcaacatgaccttcgaccgtttttgtttcctgccccggcatgctgacggcaagggcgcagcggaaacgggccgtgcgctgctctttttcgatgccttttaattctgacagcaccttgtccatattcgccttatcatcttttgcttctccggcataacgggctgaataaacgcccggtctgcctccaaggttgtccactgataaaccggagtcgtctgcaatgaccattttgttgacggcttttgccacggcttccgcttttaagatggcgttttcttcaaaggtatgtccggtttcctcaatttcttccgtaaatccgatttccgccaaagaagagacgctgtagcctttcggttcgagtatttccttgaattctttcacttttccctgattgtgtgtcgcaataatgacttctttcacgctgatcaggcctctctttcttatttcagttcaggcaatgtttctcccagcacttctttttgcttttgaataagcgtctggattcctttttcggcaaggcttaacagtccgtttaaatcttcacgggagaatgtggcttcttcgcccgtcccttgaagctctacaaaacgtccgcttcccgtcatgatgatattcatgtcgacttcagccgccgaatcctcttcataattcagatctaaaagaaggccttcttctttatccatcccgacagaaatggccgcgagataatctgtcacgggagaggttttgataacgccgctttttacgagtttgccggtcgcaatggccattgccaagaatgcgccggtaatggaagccgttcttgttccgccgtcagcttgaatgacgtcacagtcgatccagatcgtccgttcgccgagcttctccaaatcaacgacggcccggagcgcgcgcccgatcagccgctgaatttccatcgttctgccggagacctttccttttgaagattctcttatcgttctttgattcgtcgcgcggggaagcatgctgtattccgctgtgatccagccttttcctccgccgcgtaaaaatggcggcacccggtcttccacagatgcattacagatgacctttgtatttcccgctgtaattaaaacagagccttccgggtgagtgataaaatccaaatcaaatgtgatagggcgcagctcatcgtgctgtcttccgtcgtgtctcatattttacctccgattatatgtacataaaccttttgttccggattgtgaataaagaaagaggcagccggaacgctaacctcttttttactagtatatcaaaaatcgcaaattaaaaactacccgtattcacttgtgccggcctcgaaacaggttttgaaagggattctcctttttcattcaccagttctgattttccgtttacttttatagaaacacttttaatcgacggctgttcggttaacgtgagaacgatgctgtccagtacgcccgatgacaccatttttgttttttcgtcggcgcttccgtaaatagagctgttaaagtccagtgtaacctggccgtctttcactttcggcttgctgagaagcttaacatcgttattaaagtccgtcaaaagcccgcttgctttgcccggtccgtcggtgagctgttcaacggcagcggtgatgtcatttgtttccgaattgtcaatccgctttgtaacaggcacgtagtattcgcttgtctctgtttccgccagataatatacagtcagcggatgggtgtctgtcagatcattcactccggccgtttcaatattaatcccgtcttttctgcttaagtcgcccgtaatcggcgtgccgcctacaggcatttctttcagttcgtgcccgttgattctgattttgactttatctattgagctgaattgggtaagcgtccatgtaatcgattgcaggattttttgttcgtcttcttttttatagtttttaaattccttcgaaaaatcagcgacggcagtgccgtcttttttaatatcgacatttaccgtcgtatccgcagggagcaccgctctgaagccgttcggcaggatttctgatacaggccctccctgaaccaagtactcaagggcctgctttgcggttccctcactgttcggaagaggcagtgtttgtgctgcgacatagccgtttttatcaatcagatacagttctcgcatgactgtattggccggctggtcggctttagaagtgccgtttttctctgactgctttggttttgcctgaattcccgcttcatcctttacatatgaaatgtcttgaggcgggtcaatttccccggctgttttatcggattgaaataaaccgcatccagataatacaaaagccgaagtaagacatgttgcagcaatgactgcaggtccttttttcagcatacttttccctcctaaggctgtttgtactatgatgtatacgagccctgtccgggaaatagaccgggaagcgcaaaaaaacccgctgtaaacagcggggtttttttgatttattttctgaccggctcttgaagggagatgcactcgacatggccgatttcgtgaccgaaccagtcttcggcaatttttgcgaagccgttccgctctcccgttgtaagaaattgatgctccggtgcatgtttcgattggtttaacaaacctttataagacaagatggtgctcacttctctcgccgtctcgtctccggaggaaatgattttcacatgctctcccatataattctgaatcgggtcttttaagatcggataatgcgtacatcctaaaatcaaggtgtcaattgatgtaccttttaaaggttcaagcgatgcttcaaccgcttcctccgctgattcctgaagaaaccgtccgctttccacaaacggcacgagcagcggacaagccgtgttctcaacttgaagttctgcgtttaacccgagcagcgcctgctcatacgctctgcttttaatggtattgaccgtgccgatgacgccgatatgctggtttttcgtgacctttatcgccgttctcgcacccggctgaatgacgccgacaaccggaatatccgttttgcgctgaatatcctccaaggcaatggccgtggccgtattacaggcgatcacgagcattttgatatggtggttttccagcaggtaatcggtcatttcccacgtgtattgaagaacttcttcttcaggacgcgggccgtacgggcagcgttttgtatctcccacatagatgatattttccttcggtagctgtctcatgatttccttagcaacggttaacccgccaaccccggaatcaatgactcctatcggctgttccaacaaaatcgcctcattttcttttcatttcatgctgcagtttcaataatgatttttcgaaagcggctgtttcttcttcggaaaatgtcgcaaacatatcccgcaaataagcctgtcttttcaaaatcacttcttggataatgcgctctccttcagcgagaagatgaattctgacgacccgtctgtcagccgggtctttgacccgctcgacaagcttatttttttccatgcggtctatcagatccgtcgtcgtgctgcaagccaaatacattttgcctgataattcgcctattgtcatatcccccaattcataaagccattgaagccccacgaattgcggcggtgtaattgcatattggttaaggatttctcttcctttttgtttaatgatcgcagcgatatggcggagtgatttttcgatatccgcaacatgctctacagattttgatgtcatttgtccatccctcactcaaggatctttctgggctatgcgctccgtgtctattttccttctttttttaagaaaatgcaagactgacggagaaaaaggaaaaaccgggattttcaccgcatgcccatcagcccgggcgccaacgcaaataaccggctccttctcgtaaagaaggaaaaccggcaagaatcagagctctagctcacccattctaagaagctcgacaacagcttgcgaacgccctttcacacctaacttctgcatggcatttgaaatgtgattccgtacagttttttcactgataaatagctcgcttgcaatttcctttgttgtcttgtcttgaacgagcaattcgaatacttctctttctcttttggtcagcagcggctttgattgaaaatctttctccttcaagtattgtaaccctccttgctaaggtgagagcgaatctgaaacgaatgggtttatatagtcaagatatcatatgtaaagggcgcttcggaggtgacgtctcttagagaaatagttatccgttcaggcgagcagaatgcctttctcccgctccgtccagctgaccgctttgccgctttttttcgacacttgaaccataacgacggaacctgtaaagcacggcaggcccgactcattttctccaaggtaatgaagggtgacggacgcatttccggcagcgcttgctttcacataaatccgcagattttcatacggcatcacctgacgcatatagtcgcactgctggcttgcgacgaccgtcatcgtttccgagttttgcgccgtcatgccccgctgtttaaaataagcgatccgtgcttcttcaaaatagatgaaaggggttacattattcatatggccgaacatatccgtttctgaaaaacgaaccgatacttcagtaaagaaagaaaacgactgtctccattcttcaaacgggatatcaatatattgcggttgtttcatcaccttcagctccttataaaaaaacctctcccgtgcggaagaggctctttttctctttcttatactctgtcgcttccgaagaaattacggaatgcttgtaaattggtatctctgttcaaagcagcgattgaagtcgtaagcggaatgcctttcgggcaggattgaacacagttttgtgaattcccgcaatctccgaggccgccgtctgtcattaaagcttctaaacgttctgctttgttcatcgcgcccgtcggatgggcattaaacagacgcacttgtgacatcggggcaggccccatgaatttcgacttgctgttgacgttcgggcaggcttcaaggcagacgccgcatgtcatgcatttagacaattcatatgcccactggcggcgtttttccggcattctcggccccggccccaaatcgtaagttccgtcaatcggcacccatgctttcacttttttcagtgaatcaaacattctgctgcggtcaacctgaaggtcacggacaaccgggaatgttttcatcggcttcagacggatcggctgttccagcttatcaatcagcgccgtacacgactggcgcggtcttccgttgatgaccatggagcaggcgccgcatacttcttcaagacagttcatgtcccatgcgaccggagtggttttctctccttttgcattcacgggatttctgcggatttccatcagggcggaaatcacgttcagattcgggcggtaattgatttcgaattcttcatcgtatggcgcgctttcgggcgtatcctggcgtgtaatgataaaccgtatctttttctcactcatgattatttcgccaccttcttcttcgagtagtcgcgtttacggggcgcaatcagtgatacatcgacatcctgatattcaaattccggagcttcaaacggaccggcatgtttagccatcgtcgttttgagccactcatcgtcatttctttcagggaaatccggtttatagtgcgctccccggctttcatttcggttatatgcgccgagcgtgatgactctggcaagctgaagcatattggagaactggcgggtgaacatcgccccttggttgctccattttgtcgtatcgttgatattgattttcttaaagcgttccatcagctcttggattttgtcatccgttttcaaaagcttgtcgttgtggcggaccaccgtgacgttggccgtcatccattctccgagctcacggtgaagcacgtaggcattttcgtcgccgtccatcttcatgatatcggcccatttttcttcttcttttttcacataggaatcaaataatgaagaagacaggtcttccgctgatgtttcaagtccggaaacatatttcaccgcattcggtccggccaccattcctccgtagatggcggaaagcagagagttcgcccctaaacggtttcctccgtgcattgaatagtcacattcacccgctgcgaacagtccgcggatgcttgtcatctgatcataatcaacccacagtccgcccatcgaatagtgaacggcagggaaaattttcatcggaagcttgcgcgggtcatcgcccatgaatttttcatagatttcgataatgccgccaagcttaacgtcaagctctttcggatctttgtgcgacagatcgagatacaccatgttttctccgttgatgccgagtttctgattcacgcacacgtcaaagatttcacgtgtcgcaatatcccgcggcacgaggtttccgtaagccggatatttttcctcgaggaagtaccaaggttttccgtctttgtacgtccagactcttccgccctcgccgcgcgccgattcactcatcagacgcagtttatcgtcccccgggattgctgtcgggtgaatttggataaattcgccgtttgcataataagcgccctgctgatagacgattgatgcggcagatcccgtattgatcatgctgtttgttgattttccgaatacgattccgggtcctcccgtcgccataataacggcgtcagaacggaatgactcgatttgcatattggtcagattttgggctacgataccgcggcacgtgcgctcatcgtcaagaacggcgccgaggaattcccagccttcgtattttgtgacgagacccgccacttcatatctgcgcacctgctcgtccagtgcgtaaagaagctgctgacccgtcgtcgctcccgcgtaagcggttctgtgatgctgtgtacccccgaaacggcggaagtccaagagcccttccggcgttctgttaaacataacccccatgcggtccaataagtggataatggacggcgccgcttcacacatcgcttttacaggaggctggtttgccaaaaagtcgcctccgtataccgtgtcatcaaaatgctcaaacggagagtctccttccccttttgtgttgacagctccgtttatcccgccctgcgcgcagaccgagtgagagcgtttgaccggaacgatggaaaacaatttaacggccgtgcctgattccgctgctttaattgtcgccatgaggccggctagacccccgccgactacgataatgcttgattgactcatgatagcccctctccctctagtaatctagttctcttacacaaacgcaaaaatcgcttttaaacctacgtatgaaagcgctaaaaatataatcagcgtcacgtaagtcgaaattctttgagaacgcggcgtaaccgtgatcccccatgtgaccgcaaaagaccataagccgtttgaaaagtggaaaatgaccgataaaacgcctacaatgtaaaaaccgagcataaacggcgagctcagaatattcgccatcatatcgaagttgacttcagcgcccatctgcgcggcaatccgcgtctgccacacatgccagctgacgaaaataagggtgagaataccagtgacacgctgaagcacaaacatccagtttctgaaataactgtagtggccagcgttgtttttcgcagtaaatgctatgtacacaccgtaaaccgcatgataaattaaaggtaagaaaataataaaaatttctaacgcatacctgaacggcagactgtccataaagccggccgccttgttaaacgcatccgctccccttgcggcaaattggttgacgactaaatgctggatcaaaaagatgccgaccggaataacaccgagcaaggaatgcaatcttcgaaaataaaactctctgttcccagacattactttaccccctgtttgatttaagtgcgaaatgtactaaaatctctgcccccacttcgtttcaattgtaagcactttattaaaatttattgacaatttcattttactcctccctcaaaagggcgtcaagaaaacgtgtacataaattataattttcggaattgattatctggagggaaaattttattttcctgcgatatctttctcacattttttcgcgtgttttataggatcatcctgtaatcctcccccctgtttaagctataataaacgaaggagagaggggaatacataatatgaagaataattatgaagcagctttagaacctttaactgaactcgacgtcagcgcatacggctacgaattaatccgggaaatcgtgcttccggatatcctcggcccggatcattcatcgatgatgtattgggcgggaaaacgcctcgcccgcaaatttcctcttcaatcgtgggaagaaatccccgccttttttgaaaaagccggctggggaactttgacaaacgcaggatcaaaaaaacaagaattggaattcgaactggaaggaccgctcgtgtccagcaggctcaaacatcagaaagagccttgtttccagcttgaagccggttttatagccgaacagattcaattgatgaacgatcagattgcagaatcttatgaacaggtaaaaaagagagcggataaagtcgtcctgaccgtaaaatgggatatgaaggaccctgtataattgaaaaaggcggtgactcaaaagtcccgcctttttgcctgcccgtttatacggcagacggctgtttagaaagctcaaacgcgtcatgaagcgcttcgaccgctttcaccatatcattttcgctgacaaccgctgatacttttatttcggatgtgcttaccattttgacttgtacatttttttccgccagtacggcaaacatgtccgcggcgacgccgggatttgaaaccatgcccgacccgacaatggagactttcgccagttttctttcggtttcaattttttcatagttaagcgcgtttttatattcttcaagtacggcgaccgtttgggcggcatcttccgttttcactgagaaagaaatatccgcttccccatcatccgactgtgtctgaataatgatgtcaacgttgatgtttcgttttgccagcgcggtgaagattgttgaaagtgttgtcaatccgcttgcaaggccagtgacggacaccctcgtgatctggtcttcaaatgcaattcctctgacgattaaattctgctccattgatgattcctcctcaattaatgttccggcttcatgttccgtgcttgaccgcacttctaaaggcacttggtagtttttcgcgaactcaaccgcccgcgggtgaagaacacccgctccgagatttgcaagttccagcatttcatcataagaaatccccgccagttttctcgctgaccggacataccgcggatctgtcgtaaatacgcccggaacatctgtataaatgtcgcatttatccgcttccagcgctgctgaaagagcgaccgccgtcgtatcggaaccgccccgtccgagcgtcgtgatgccgccgtcttccgttacgccctgaaaaccggcaacgactgtaatcctgccttctgcaagctgcgaacgaatcgccgtgatatcaatatccgtaattctcgcattgccgtgaacggcttccgtgcggacacccgcctgccagcccgtataagagacggcgtcatatcctttttcctgaagcgccatggccaaaagcgaaatcgtgacctgctcccccgtagacaaaagcatatccatctcgcgtctgcttggttcagatgtgatttcagccgcgaggttaacgagcgcgtcggttgattttcccattgccgaaacgacgactacgacatcatggcctttttgcttttcagcaatggcgcgatttgcggcattttgaattttttcggcagagccgacggaagtgcctccgaatttttgtacgataagacccatactagaccaccctttacattttggttcgtgcgggtgaggagaaaagagcgttttgtccacaataaaaaaagcaatgagaggaatagctctcattgctttttcatatcagtacgattgattatgaacaacgagatagccctccaagaaaatgaattcttgacagccttacatttatttaatgcaaggccagcaaatcacaccgatgggatgtgatacacttcggcgacgctcccctttcagcctttttcgcagaatccatcattctccaaaggcttactattgaagttcgcacctctatcttcaccatataacacgatcttatgaaattagttcacattctagcagatttttcagaaaagcacaatactatttttttaatttttcaaacagcagctgggccgccgcggccggcacaccggcttttttgatatcgtcaagacttgcttccttcatctttttgacagatccgaaatgttttaagagcgtttttttgcgtttttcgccgattccggggatatcatccagaacggattgaaagacgctttttccccggatctgtctgtgaaagctgatcgcaaaacggtgaacttcgtcctgaatgcgctgaagcaggtaaaactcttggctgttccgctccagaaacaccggttcaagcgggtcgccgatcaaaaggttcgatgtccggtgcttatcatctttcgccaatcccgctaccgggacatcaaggccgagttcattctcgagcacgtcgcgcgccgcgttaatctgcccttttccgccgtcaatgatgattaaatccggcagcggaagattttcgcggagcaccctcgtgtatcttcttctgacgacttccctcattgagccgtaatcgtccggccctgttacggttttaattttatatttgcgatattcctttttattcggttttccgtctataaagacaatcatggccgatacggggtttgtgccttgaatattggagttgtcaaacgcttcaatccgatgcggcgtgtaaatattcagtgcttcgccgagccgttcggctgcaccgattgatcgttcctcatcccgctcgattaacgagaatttttcccgcagggcgattttcgcatttttgtgcgcaagcaaaagcagctcttttttcggaccttttttcggctgatgcacggcggtttccaacagctcgccgatcatgtccctgtcaacgctgtcaggcaccagaatttccttaggcagaaagtgattgtttttggaatagaactggccgatgaaggtcagaaactcttcatccgcttcctgatacatcggaaacatgctgacatcgcgttcgatcagttttccttggcgtataaaaaagacttggacgcacatccagcctttatcgtaggcatatgcaaacacatcgcggtccagaaggtcattcatggtcattttctgcttctccatcgtcgattcgatgtgagcaagctggtcgcggaattctttagcccgttcaaattcaagcttttcggccgcttctgccattttcgcttcaagctcttttttgatttcgttatgccctccctttaaaaaacgggtgatgtcttcaacaatctcgcggtttgtctcctcagatatatcctttacacatggggcgaggcattggccgagatgataataaagacagacgcggtccggaagctttgagcatttcctgagcgggtaaaggcggtccagcagttttttcgtttcccgcgccgcctgcacattcggatacgggccgaaatagcgtcccttgtcttttttgacattccgggtgacaatcagccgaggatgacgttcatgggtgattttaataaagggataggttttatcatctttcagcatgacattgtatttcggatcgtattttttaatcagattcatttccaaaataagcgcttcaagattggaggaagtcacgatatattcaaagtcctcaatctccgtcacaagccgttgggttttcgcgtcgtgagaaccggtgaaataagaccgcaccctgtttttcaagactttcgctttccccacgtagatgactgttttttgacggtctttcattaaataacagcccggctgatcgggaaggagggccagcttttctttcagttgtttattcatacgttacccttccttacattcatttctcgtgtccattcagtgtatcacgaacatttgtttttctccattctcagcttttggaagatcaaaaaaaggcgattccctttcaaaggaatcgccctgccgtaacggaagctttcggcttacagatgtttgtttacaagctcttcaagagcttctttcggtttgaagccgacagatgtttcaacgacttctccgtcttttagcacgagaagtgtcgggatgctcatgacgccgtatttaccggcagtttcttggttttcatccacgtcgattttgacgattttcagtttgtctcccatttcttgatcaagctcttcaagaacgggcgcgatcattttacaaggtccgcaccaaggagcccagaaatcagccaatacgacaccttcacttgtttcagctgagaacgattgatcagttgcttttacgatagccatttgttattcctccaattgtcaaatgatgatttttagtatagcatctcccattcgttcatgctaatttaatgcttatattattttcccccgaacccgccggaaataatcttatttatacagtgtattataaccgggcggcgggcgttcaaaacttaagatggacctgcaggcagcgtgattaatacaatcgccatcggaggaagctccgcctcaagttttcctcccttttgagcaaacccggaaaacggcatcggtttgacgttttccggactgctgaatgtattgtgggcattcattttttccgcgtgcagaatcgttcccgaaggcgtccctgtctttttcatgccccgcagttcaatcttcacgtcagctttgtgcagatgatcgatattgcaaatgcttatatgtatgtctccgttctgctgtttggacgctgaaatgctgacttgcgggagccggccgtcattccattcgtacccggctgcatttgtttctgccgccaaaagagatgcgtcctggtgcaccttaaacatatcgaacacatgatacgtcggcgtcaacagcatttctttcccttctgtcaggatcattgcctgaagcacgttgacggtttgcgcgatattggccatctgtacgcggtctgcgtgctgatgaaaaatgtgaaaatgcgcggcggcgacaagggcgtcgcggatcgtattctgctgatacagaaagcccggatttgtgcccggctcaggatcaagccacgtgccccattcatcaatgatcagcccgactcttttttcgggatcgtactgatccatgatggcgctgtgccttgtgatcaattcatccatatgcgccgcttttttcatcgtgatgaaccattcatcttccgtaaactccgtcgctgatcctttccccttccagaagtcgcccggtattgtgtaataatgcaggctcagtccgtccatgagatccgcggcttttttcattaaagtttcagtccagcggtaatcgtcgacattcgcgccgccggcaattttatagatttcattaccgctgtaattgcggacataggtttggaagtttctgtaaatgtcggcataatactcaggatgcatgtttccgccgcagccccagttctcatttcctattccgaaatatttcagcttccacggtttttcccgcccgttttcttttctccagtcggacatcggcgtgcccgcttcaaacgtcatgtattcaatccaatcagccatttctttaaccgttccgctgccgacgtttccggcgatgtacggttcgcatccgagcagttcacaaagcatcataaactcgtgcgtgccgaattcattagaatcaatcgtcccgccccaatgggtattcagcattgttttgcgtttccctacgccgtttgcccaatggtattcatcagcaaaacagccgcccggccatctgaggacgggaatctgaagctgcttgagggcagcggcgacatccgtcctgacccctccggtattcggaatatcggaatcttttccgacccagatgccctcatatatgcctcttcccaggtgttccgcgaaatgtccgtatatgtttttattaatggttccccgtgtgatatcagtttgaatgactgccgtattgtgagacaaacttgatcattccttccccttaataagaatgaaagcactacagccgatctatctgggatgtatgctgtatggataagtttgtaagcgctttacaaaagcttattacattggttcgtacatgtcaatctgttgttttattaatctataatttgtacgaactaattaacacaaaccaaaaccctctgacaaataagccagagggttttgattatgaatgaatattggcatttttaaattcctgagtcagaagcggaaccacttcgaacaaatcgccgacaattccgtagtccgctattttaaatatttccgcttccgggtctttgttaatggcaacgatgaccttactgtttgacatgcccgccaaatgctgaatcgctccggaaattccgcaggcgatatacaaatccggcgtgacgacttttcccgtctggccgatttgaagagaatagtcgcagtagtccgcgtcacatgcgccgcgcgaagcgcccaccgctgctccgagcacctcggcaagttcttttaacggttcaaatccatctttgctttttacaccgcggccgcctgctacgataattttcgcttctgataaatccacgccgtccgccgtttttttgactacttcttcaatgaccgtccgcaaatctgccggaggcgccgcaagctcttcaatatcacccgcccggttcgcgtctttttctaatgcctgaatattattcggacgaattgtcgccagaatgaaaggatcggttgaaatcacctgttcaaaggctttgccggaatagatcggtcttgtaaaaacgatgttatctccggtaacgcttacatccgtgctgtctgaaatcagccccgtttcaaaccgggccgcaagcttaggtgacaaatcttttcccatagaagtgtggccgaaaatgaccgcatcaggcttttcattttcgatcaaatccccgagaattgcggcatatccgtccgccgtatactgagaaagccccggcgaatcggctgtaaatactttgtcggcgccgtactgaatgagttctgatgctgcatcagccgcgccctttcccatcagcacgccgatgacatctcctccgccggaaatggttttgcctgcggctatggcttcaaaggtgacgttccgtaaggcgccgtcacgaatttctccgagtacgatcactttttttcccattctgacatcccccagtttctttaatatcagtttatacgactttggcttcttttctcagcagtgatacaagctccttcgcctgctcagcggcttctccttcgatcagtctgcccgcttctttttgcggcggcagaaaacgttcgatcgttttgagcttcggtgcggcatcatcttcatcaatgccgaggtcatcgagctcaagttcttccagcggttttttcttcgccttcataatgcccggaagcgacggatagcgcggctcgtttaagccttgctgtgccgtgatgactaaaggaagtgaggttttaatgatttcggtatccccttcgttgtctttctctgccgcagcttcatcgccgctgattgtcagttttgtaatcgttgtgacgcaaggagtgttcagcagttcggcaagccttggagccacttggccggaaccgccgtcaatcgcgacatttccgccgagaatcagatcatattcccggtccttgaaataatgatataagatagttgaaacggagtattggtcaggatcgctcagatcatcttcaatattgattaacaccgcctggtcacagcccatcgcaagggcggttctcagttctttctccgcatcttctccgccgacggttacggcggtcacggttccgccgtgctcttccttcagctgaatggcttcttcaatggcgtattcatcatacggattaatgataaattcggccccgtcctcctgaatctttcctgcttcaatgacgattttctcttctgtgtcaaacgtccgtttcatcagtacaaatagattcatattcttatcccctttatcttcgcccaccgaattgaggctttcttttttcgagaaatgcctgaatgccttcttttgcgtcatctgatgcaaatgcttccccaaagcgctttgcttcaagctttaagccgccgtcataagaatagaccttgtttgaataaaggagctcaagcagagaagccatcgactgcgggcttttttccgcaaacttgcccgcgagcgttttcgctttttgcagcagctcttcttcatgttcggcgcctatcgtgacaagaccgaggctgagcgcttcttctccggttacaggttctgaagtgccgatcatttcaagcgctttcgccgtaccgacgtaccggggaagccgctgcgtcccggcaaagcccggaataatgccgagattcagctcgggcaggccgagctttgcatctaatgtagcgattctgatatggcaggccatggcaagctcaaggccgccgccgagcgcagcgccgtgaatcgccgcgataacgggcttcggaaacccttcaattctttccatcagctgctggcctttatccgccatggcagaagattgctcaagattttcaagcgacgtaaattccttaatatcagcgcccgccgagaaaaatttcccctcaccgcgaataatgatgcttctgacgctgtcatctgtttcacaccggtcgaacagaccggacaactcatctaaaaccgcgccggacagcgcgttggccggctgatgattaatggtgatcaccgcaacagattgttctaccgccatcgaaaggctgttcatccgtcaaccccctttagttttgatgaatccctgacaccaacagctccaataccttgcctgacaaatccggaagatcatatttctgatcgttcatcacccatgttgtcactgtttcatctatcgtcccgaatatcatctgccgggcgaggcggacgtcgagattatctttccattcgcccgactcgattccttcggtcaaaatggtgtccagcatgtttaaataaccttttaaaatatcattgattttcaggcgcagcttgatattcgactgtctgagctcaagctgggtcacaatcgcgaggtggcggtcattgccgagcagtgtgaaatgctgcttaataacgagagcgagtttttcttttgccgtcgttttttctttcacttcttcttccatgcgttcaatgaactggcccatcttttctttaaaaagagaaatgagtatatcctctttgtttttgaaatataaatagatggtgccgtccgcaacgccggcctgcttggcgattttggacacctgtgattggtgatagccgttttccgctatgacttctactgctgcatcaataatctgcatatactttggccgtttttggttcaatgtcatcgttccttccttcgataaatgaatgactattcattcataacttcatgataaaaaggaatccggattttgtcaagtttttcttttaaggcaccttgttttcatgggaagcatcttcctcttcgactaaacgccttcttaatatttttccgacggccgttttcggaagctcttttctgaattcgtacagcttcgggactttgtacggcgcaagccgctctcttgcaaacgcatcaagctcatcggcatctgcctcggcgccttttttcaaaacgataaatgctttcaccgtttcccctctgtaggaatcagggacgcccgctaccacgatttcctgaacggcatcatgctcataaagcgcctcctccacctcccgggggtaaatgttgtatccgccggcaatgatgatgtcttttttcctgtcggcgatgtagaaaaatccttcctcatccatatatcccatatctccggtaaacagccagccgtctctgatgacacgcgccgtctcctcctgcttattccaatagcctttcatgacctgagggccttttacgatcagctcgccgtgttcatacggctccgcaagcccgcctttttcttctgaatagattcccgcatcggtattgggccagggacagccgatgctgccgggtttattttttccccagatgaagtttgaatgggtaaccggtgatgcttcggataatccgtagccttccacaagctttcctccggtcactttttcaaatttctgtttgacctcaaccggcagtgccgctgaaccgctcggacagctttcaatggaggacaaatcatacttattcagctccggatgatgcagcagcccgatgtaaatcgtcggcgccccggggaaaaccgtcggcttcagcctgtcgattgttttcagtgtatccaaaggattgaatttaggaagaaggatcatttcacatccctgcataatggaaaaattgagcacggcggtcaatccgtacacatgaaaaaaaggcacgatgccgagcaccttttcggctccctttttcattttgtacatccaggcggcgcacatttctgtattggcctgaatgtttcggtgtgtgagcatgacgcctttcggatagccggttgttccgcccgtgtattgaagcacggcgatgtcatgcgcagggtcaatatcaaatggctctgcttcctctgctttttcgttttttaaaatatccgctaatttgtgaatttgttcgcagccgtcataatcaatatgcacctgttgcttttgcgtgagcgtataaagcatatttttcggaaacggcaaaaagtcttttatacttgttgtaataatgcgttcgacgagtgataacgttttcatttttatcactttcggaaacagcatatcgagggtgatgatcacgcgcggcgcactgtctttcagctgatactcaagctcgtgttccgtgtagagaggattggtctgaacgacaatgccgccggcaaacaatacgccgtaaaaagcgatgaccgactgcggacaattgggcagcataatggcggctctgtcaccttttttcaggcctgttttgcgtaaaaaagcggcaagctttaatgaatctgtgagaacgtcttggaatgtgagtttttttcctagaaaataaatggcggtatggttcgggaattgagctgcggagtttgtcagattggatggcagggtttgatcggtaaattcaagctcatgcggaatctcttcgggatattgagaaagccatggcttttcagactgcataatacctctcccttctgttttcctatacgctattattatagcagaagggtgattggaatgggaaagcgtttcatgggaaatttcgagtttcaggaggtgttgagttttctggaaacgctgcattttgaagggggagttcctatcctgcgccagctgccgaagccgattacgtcggccgcctttttgctccatccctttgtccggatgccggatggtcgggaagagcaaaagcgcaaacggccttatgaacatatgtatccgagtgatgaggagatcatcgcgatgggcagacccgtttcctggcaaaccgtcatgagcatttgcggcctgcgttctgaaaaagaaacggcgcttgcgcttatgactgctgtcacggcattgcggggggaatatgcacatcctgaatccgccgagcggttaaatcggctccatcatccgatctgtacttgccgagcgatgatgtcacttcgccatttttgattccgggacttttggatgtgttccgttcaaaaggcataaagcgctgcatttattatgagcctgtcgaagagaaaggcctattttcactcaatcaaacgacggcttcggatgtatgcggactgctgcgggctgacatgatcattgccgatgaaaaacggcgcgccgcttttatgagcatatatgattcttttacgacactctttctcatggaagaacaagacattcagtctgtcgtccgcgccatgaattgggaagccgtcatttgctctgatacggcctgcataaactggtattctcaataaaaaaggccgccgatttgagttcggcagccttttttcagtattaagatgtcatgaccagataaataagtccgatgaacagaaaaatccccgctgccgacagcagcactttcgcaagcttctccatttttccccgtccccttaaatcccggcggccaccacaaatgacaggccgactgagatgacaaatgaaataaagccgacagctctgttatctttttcaatttctttatcaattttaaaccggggcgtcagaaattcaaagataaaatagctgattaaaagcataataaatccgtatacgccccagccgatcatttgcaaaagcgaattatgctgggcgatgctgtgctgaaagacatttgcgataccgagaattttccctccggtcgccattgccaccgcaagattgcctttttggatttccacccagtttttataggatgtcaccaattcaaacacggtcagaaaaatgacgagacacaagacggcaacactgtaataagccgcgatttcaacaagctcattttcccaaaaagcattcatgacgttttctccctttttattttagttcgacaatcgttacgcctgatcctccttctcccgcttccccgaaccgcgagcttttcacgctgcggtggtttttcagaagatcctgcaccccttttcggagggcgcccgtgccttttccgtgaatgatggacactctcggatagccggcgagcaccgcgtcatctaaatatttttcgacgcggctgagggcgttttcgtaacgctctcccctgaggtcaagttcaagggatacatgataatccttcccttttacggcggtgattgctttttcttttttcggttcaggagccgatttgagaaactcaagatctttttccttcaccttcattttaaggatgccgatttggacgttccattctttctcgccggttttttcaagcagcgcccctttttgtccgaatgtgagcacctttacttcgtcgcccggcttcagctcgcgttttttctctgtttttctttccggctgctttgatttttcaaaagccggcatcgcgtctccgagacgttttttggcgtcaatcagctcgtgttccttaaaggatctgtgttcttgcttgatggacctgagctcgcggataatctgttcggcttcatttgcggcggcttccagtttttccgcagctttccgctcggcttcttccatcattttatctttttgggcattcagctcaatgatttgctgctgaagctctttgtgcagtttttctgcttcttttctgagtgattcggtttcagaaagctcttcatccgctctttttttgcttttttcaagcgatgcgatcatcagatcgacttcgttatgttcggcggtcatttctgacttcgcctggccgatgatatgctccggaagcccaaggcgtcttgagatttcaaatgcgttgcttcggcccggcactccgatcagaagcttgtaggtaggcgaaagcgtttcaatgtcaaattcaacgctggcattcatgacgccttgtctgttatatccgtatgctttcagttccggataatgggttgtcgcaagcactctggcgtttgtccggtgaacttcgtcaaggatgctcatggcaagcgcagccccttcctgcggatctgttccggcaccgagttcgtcaaacagcacaagactgttttcagacacgtcttttaaaatattgacgatattgaccatgtgggatgagaacgtactcagactttgttcgatcgactgttcatcgccgatatcggcaaacacattgtcaaatacggctgcttccgagccctcgtcagccggtatgtgcaatcctgcctgcgccattatcgtcagcagcccgagtgtttttaacgtaacggttttaccgcccgtattcggtcccgtgatgacgatcgttgaataatctccgcccagttcaatatcgttggccacgacttgatcttggggcagcagcggatggcgcgcttttttcagacggataaagccgtctccgttcatgaatggttttgtcgcctttattgcttttgcgtatctcgctttggcgaaaatgaaatccagtgtctgcagcacttccacattttgagcgatttcttgtgtgtgttcagccgtatgctccgtcagcatccggagaatccgttcgatttcctgtttttcttttactttcgcctgctgaagcgagttgttcatatctacgatcgcctgcggttcaataaacagtgtcgcaccggatgaagatgtatcgtggacaattccgccgtagcttgatctgtattcctgtttgaccgggatgacaaagcggtcattccgaatcgtaacgatggtgtcagacagcattttagaagcggaagatgaacgcagcatcgattcaagccggtctctgactcttgattcaagcgtcctgagctgcgtgcggattccccttaaagcgggagacgcatgatcaagcacttcaccatggtcatcaatgcaggagttaatctccctttccaaatcgcctaatgtaatcagctcttctgcatgggcctgtatcagcggaatgccgacgccgtcttctgtcatctggctgataaaatgcttcatttgtttaacggcatacagcagcccggacaattcggtaaattccgccggcgtcagcacactgccgatttccgcccgccgtaaagcggatcttatgtcggtcaggccgccgaacggagcatggcctctcaagcgcatgaccgcggatgcttcttcgacttcatccagctgtttttggatgtcggcgagatccgtcaaaggtttcagctgcagaagcttctccctgccgagcgatgaggcggcatgtgcggtaatctgttcttttactttatgaaattcaagtgatgataacactttttgctgcacggttttatggtcctccttacttaatcattgcgcgtcagaaatgctttgacctcatgtaacggccgggcgtttaacacatgttttgtctccgtccagcctttgcgcgcagcggtcacgcccgttttcatatcatcgagcatctcgatattatgggcatcggtattaatgaccaaagtcacacctttttcatttgctttgatcaaatgctcagtccgtaaatcgaggcgcgcggggtttgcattcagttcaagcgccgtatttgttttggctgcgagctcaatcagcatgtcgatgtcgacttcatagccggcccgtctgccgatcaggcgtcccgtcgggtgggcgataatgtccacgtgcttattcgtcagcgcctgttcaagccgtttcataatgacatgctccggctggctgaagcttgaatgaatagatgcgatgacaagatccatttcagacagaacgctgtcatcataatcaagcgaaccgtcggggagaatgtccatttctacgcctttaaaaatatgaaaattttcaaattcagcgtttaacgcgtcaatttcttccgcctgttttctgagccgttcggccgttaacccgttggctacctttaaatattgggaatggtcggtgatcgccatgtactggtagcctttttccatacatgcttctgccatttctctgatggaaaaagcgccgtcactccaggctgaatgcatgtggagatcgccttttatcgctttatgctccacaaggtccgtttcttcccggtacgtgtcgacctcctgcccgctttctctgagctcaggaggaataaacggcagaccgaagtgggcgtaaaacgcttcttcgctcgggaatgttttgacgtctcccgtttctatggtttctactccgtattcactgatccgttcaccgcgctctttcgccagctggcgcattttaatgttgtgatctttagaaccggtaaaatgatgcagtgtggtggcaaactgttcctctgtcacaagccggaaatccacactcgtctcatattcaaatgtgaggataaccgatacttttgtatccccgcccgctatcacgtcttttacgttcgggagggaaagaagctgttctctgacagcctccggatgatctgtagcgataatgtaatccagatcttttacgttttcccgcgctcttctgagactgccggcccgggaatatttctgaatatccgtcagccgggccaaatgttcttcaatgactgaggcaatgctgagcgcatagccgatcggaaaccgttccggctgttttccggcttctccgagagcctggaggattttctcctccgtttttttgccgaaaccggcgagcccctgtactttttgctgctcgcatgcttctttcagcgattccgcgtcatgaacgccaagctcctggtacagcttggcgatttttttgccgccgaggcccggaagcttcaaaagaggaaccaagccttccgggacttctttctgcaattggagaagcgtgccggacacaccttcctgcatatattcacgaatgacgccgtaggtgccttttccgattccggataaagacatcatgtcgtcgatttccgacaggctgcggtcatcctgctcaagcgccgccgccgcttttcggaaggctgatattttaaacgggttgtcccctttcagttccatatagaccgcaatcgtttcaagcagcctgatgatatcttttttatgcatactgttaacccccagtcgtttcctgcttttcatcatacaaatttttctcttccggcacaactgacgcagagcttgaaaaaaacttctccggtcaagagaagtttttatgccccgtactgggcccacagttcttgcaggagccccgacagatacggcgtatgatgtgtgatgatatttgcaagcgtcgattgtgcgagcatatcctgaagcacgcttaccggcagtacggatgcgacgtataacaggataaacgcaaataaatagacttccagaaatccaagcaccccgcccagcagtttgttgatctgtttaatgaccggaatgccggcgatgatattaagcgccgctccgataatccggagcaggatctttgcgatgataaacaaaatgacaaacgcgatcgcgttgtaataagccgtctccacgtttcctttaataaaagacagagccgcctgcccgccggaaaaatcaggggcgggtataaagctcagatgcggggccaggtttttgtaaaaaagcgccgcaaacgcaatcgagaggatgaaactcgtcaagtatataaattggaggataaatcctctttttaatccaagcaatgtgcccattaagagcagaactaagatgatgatatctatcatatggtgttcattccttttctttaagctgccgctccagtatttcatatttttcttgcagtttcatataatcatgcacgacattgaccgcagtcaatacagcgagcttatttatatcaagatatggatttttctcgttgatttctctcattttatcatcaaccattccggccacatggcgcatgtgcgctttgctttcttccccgataatggtgaagtgctggccgtaaatgtttactgtcgttttggtttttttgccgtcagacaacgtttctcctccattccgcgagaatcctagttcctatcataccacgattatcgtttgaatggaaagacgagcctcgggctgttatgatacactggtatatacagtgaaaagtgccaaaaaaggagattatatcgtgtcccattctgttataaaagtatccgcttccgctatggaacaaatgaaacaatcctatgccggctcccttactcccgccgttccgcagggcgccgtcttccaggccaagcccccgggctgtaccattacagcctaccgctcgggcaaggttctctttcaaggaaaaaacgccggcacagaagcggcccgctggggaacggctgaggcgccgaaggcaaagaaaaccgtcaaaaaagcggccgacccggtttacgctcccccggcgggcattgcctccatgtcagtgatcggctctgatgaagtcggaacaggcgattacttcgggccgataacggttgcctgcgcttacgccgacaaaacaaagctttctttaatgaaagaactcggtgtgaaggattcgaaggatttaaaagatccgcagattattgaaatcgccaaactgttaattaaaaccattccttacagcctgcttgtgttgaaaaacgaaaaatacaatcagatgcaggaaaaaggcatgagccaaggaaaaatgaaggcgctccttcataatcaggcgatttccaatctgctgagaaaaatgaacggcgttaaaccggaagcgattctgattgaccaatttgcagagcccggcatttattttaagcatctttccggacgggatatcgtaaaagaaaaaacgtttttcagcacgaaagcggaaagcatacatctttccgtcgccgcagcctctatcattgcgcgatattctttcttaattgaaatggataagctttcccgtgaggctgggatgacgattccaaaaggcgcggggccgcacgtcgatgaagctgccgccaagctgatcatcaataagggagaaggtgcgctcagaacgttcaccaaacttcattttgccaatacgcaaaaagcgaaacgccttgtagaacggaaacggtcataataaaaaaagcttgcagaatgatctgcaagctttttctttatcctcttaataccgcctgatacgtttcttccagcgctttcagcacgttttcatgtacttttgtcacttcttcttctgtcaatgtttgttcagggttaacatattggagcgagaaggcgacggattttttgccctcttccatatgctcaccttcgtacacatcaaatacggtgacttctttcagcagcgcgccgccggcttctttgatcacggcttcgagctgtccgcttgtaacggttttatctgccacaagcgcaatgtcgcgcgtgacggacgggtacttcggaatcggcgtatacacgacaggttctgtttcctcggtcagaagcgcgtgcagatctagctcgaacacatacgtttctttgatatccagctctttttccattgccggatgcacctggccgataaatccggcaagcgaaccgttcaatagaatgtttgccgtccggccgggatgcatgtttttgcgttctgactggacaaattcaacccggtctgacacattcaattgatgcagcaggccttcaacgattcctttggcgacgaagaaatcaaccggctttttctcaccctgccataaatttttacgccacaatccggttacagctccggcaacccgttctttttcaaccggttttgtgttttcttctttcgtcagaaatacagaacctgtttcatataaagcaacggaatcagtctgtctggccagattgtatgaaacggcttcaagaagattcggtacgagactgtgtctgagaatgcttctttcttcgctcatcggcagagcaagcatcgtgttgaatgatttttcgatcgcaaaagcggccgcttttttatcattcgttaatgaataagtggtcgcttgtgaaagacccgctccttcaaggaaacgtctcactttccggcgttttgcctgatacggtgtcaagccgcctgtcgtgccggccgtttccggaagcgtggacggaatattgtcatacccgtacaatctcgccgcttcttcaatcaggtcttcttctattctaatatctccgcggcgggacggcactgttacgacgagaacgtcttcagcttcaccgactgcaaacccgaggcgcttgtaaatgctgatgatttcttctttagcgattgccatgccaagcacggcgttcactttttcaacagacacgtgaatgttgtttgcttcgattttcagatggttttcttcaaccgtgcctgagagcacttctccgccggcatatgcctgaatgagactgcaggcccgttcagccgccagcaaaacgcgggccggatcaatgcctttttcatatctggcgctcgcttcgcttctcagtccgaggtctctcgacgctttgcggacggtctgtccgtcgaaataagcggcttccagtaaaatcgcagtggtgtcttcacggacttcagactcggctccgcccatgactcccgcaacggcttgcgctttttttccgtttgtgatgaccaaatggctgcttgacagcttgcgctcttgttcatccagcgtcacgatggtttcgttttccgccgcttttctgacgacgacctcttttgaaccgaaccggtcgtaatcgaaagcgtgaagcggctgtccgtactcaaggaggacgaagtttgtaatgtccacgacgttattatgcgggcggatgcctgcattcatcagcttcgtctgcatccaaagcggtgacgggccgattttgacgtttttaatgatttttgcggcataatgcggattggcctgcgtatcttcaatcttgacggaaacagcatccgccgctttttctgccgctttttcatatgaagcctccggaagctttacctctgcgccgaggatagccgccacttcataagccaccccaagcatgttcatcgcgtcggcgcggttcggcgttaagcccaattctaaaatcgcatcatcaagctgaagggccgccattgcgtcagctcccgtttcagcatcattcggaaaaacgaaaatgccttccgcatattctttcgccacgagcttgctctcaatgccaagctcctgaagggaacagatcatgccgtgagacgcttcgccgcgcagcttggcttttttaattttgaaattgccgggaagcacggctccgaccgttgcaacggcaaccttctgtcctttatcaacattcggggcgccgcagataatctgcacgggttcctccgcaccgatatcaacaaggcatttgttgagtttgtcggcattcgggtgctgttcacgctcaagcacgtgtccgatgacaacgccttttacgccttcccctttatactcgataccctcaacttcaataccggctctcgtaattttttctgcaagcacggccgggtcgattccctgcaagtcaacgtaatcttctaaccatttataagaaacaaacatgtgtatcctcctcttacgcctgtttaaactgcgaaatgaatctgacatcattggtatagaaatggcggatatcttcaatgccgtatttcagcatcgcgatacgttccacacccattccgaaagcaaaaccctggtattcttcaggattgaaaccggccatcttcagcacgttcgggtgaaccatgccggcgccgagaatttcgatccagcctgtttttttgcagacggagcagccttgtccgccgcacttaaagcaggtcacatccacctcgacagaaggctctgtgaatgggaaaaagctcggacggagcctgatttcacggtcttggccgaacatttttttggcgaccaattcaagcgtgcctttcaggtcgctcatgctgattttgcggtccacgacgagaccctcgatctgcatgaactgatgggaatgtgtcgcgtcatcgttgtcgcggcgatacactttaccgggacaaatgattttgacggggccttttcctttatgcttttccatcgttcgcgtctgcaccggtgacgtctgcgttctcatcagcatttcttctgtaatgtaaaagctgtcctgcatgtcgcgggccggatgttccttcggcaggttcagcgcctcaaagttgtaataatccgtttccacttcagggccttcttcgacggtatatcccatgccgataaataaatcttcaatttcttcaataacgaccgtcagcggatggcgtccgccgatgtttacctgactgcccggcaacgtgacgtcaatcgtctggctgctgagttttttattcatctcttcttgttcaagctgttcatttttcgccgtaatggctgctgcaatgcgctctctcacttcattggcgagcgctcccattttcgggcgctcttcggcggacagtttgcccatgccgcggagaacttctgtaatcggccctttttttccgagatattgcacccgaatgtcgttaacttcttttaatgaacccgccgcttctactttttctgcagcttccagttcgagctgtttaagcttctcttccatcatgcatcctccttttatgtaaaccaaaccgttctatgcctttttcagaaaacaaaaaaacccgccccttgagagaagggacgagttgtggccgcggtaccaccctttttaaggcagacttcatctgccgacagcttcattgacataacggaaacgatcgttccggttcacctttacgcgcgtttggcgcggtcccggtgacaactcgagaggtgaaaatcaatttctgtgctgcgataaaaatgctctcagtcagcggcattttctccctggaaggcagcgtgtgcaaaaattgacgtcctctgtcacggtttttacattattgctatctattatagtgaaatccaagatttttcgcaacctatcctctgagatgataaacgaggatggcggccgctaccgccacattcagcgattccgcctgtccgtacagcggaacgtacagattgagatcggttttttgcagaaggccggcgtccacccccgccccctcgttcccgacgattaacgcgaacgattcttcaggcttcacgctttgataagccgcaccgttttcaagcgccgtgccgtagatcgcgacgccttgtgatttcagctcggcggtaaactcatcaagcggacgttttaaaatgggaatatgaaaatgagatccttgcgctgaacgcagcgtttttccgttgtacgggtctgccgttccctcaccaaggacaacggcgtcgattcccgccgcatctgccgttctgatcattgttcctaaattccccgggtcctgtacggcatcaatcagaagcagccgcttcagctgatcaggccgcttatccggcatatggcagaccgcggcgatccgctgcggcgtttccgtttccgtcacggctgaaaacgcgtcttcgctcagcacgtagcacggaatgctcatatccagatcggccggaatggcgctctcatcgtttacgagaatttcttttaccgttccctttgatttgagcgcttcttctgccagatgctctccttctatcagaaatgtattcgttttaagtctctctttttttgtgtgaagttttttccagtccttcactttttggttttttgcagagtcgattcgtttcactttatgtctgtgctctccttttttcatgcatgttgttattatatctcaagaacagcacataataaaccgcgtgcgcggtaagaatatgcgtatcacattcaggaaaaaggagcggttgtaatggatcttaatttacgcaacgccgttattgccaatgtaaccggcaataaccaggatcagctggagcatactatcgttgacgccatccaaagcggtgaagaaaaaatgcttccgggcctcggcgtcttattcgaagttctttggcagcatgcgtcagactcagaaaaaaatgaaatgctcaaaacacttgaaggcggattaaaacctgcgcaataagcatgaaccgggtgatggcacacccggttttttttgtataataatggcgagggggatcgccatgcagttacagccggaactggcaaagaaattgattgccgaagtcaaacatatgtacagccgcgaagtgattattgccgatacaaaagggatgatcatcgcgggcaccaatgaggcgcgcgccggatggtttcatgaaggcgcactgatctgcgcccgcgaaaaacggaatgtcatcattacgaaagaagatgaaaaacgcctccagggcgtaaaagcaggactgaacctccccgttttttcaggccatgaggtaatcggagtgttcggtctgacaggagaccctgacgatatcctgcctttcggagaattgctcagaaaaatgacggagctgtttattaaagaaacgcgccatatggaagaagcgcagtggcgtgcgagaatgcttgaatcctttatggttgattggctgcagctgaaagaatggtctccgggctttttagaaaaagcaaagctcatcggcgcagaccttcacgcataccgccggatcatactcattcaaggacgttatgagcaatataaagcggaggagctcgggcggctctggcagaacgaatgccctgaagacctgtttgtccgctggggaaatgaacgcattctcattaaccatgaagcaaattcggcttccaaaacacagctcatcaaaaagatcggcgccgtttttgggcagcctgtcaccgccggcatcggacggatcgttccgggagagcgcctcgcggaatcatacgaacaggcggataaagcactttcagccggaatcggtgacaagcaggccgtctttgaagaagatttaaaactggatatgtgtattgccgatatcgcgcccggcacgaggtcggaattttcacggcgggttctcgagcatgtactcggccgggaagaacttctggatacgctgcgcgcctttttcgaccggcaattatcgttaaagcgcaccgcagacgacatgcatattcatatcaatacattgcgctaccggctttccaaactggaatcactgacaaatatgaagcttgaccgccccgaagacataacggctttttatttggcgctccgctttttagatcaacatacaaaaagcacgtaatcatatcatcatttttcatatgtttctccatagtgtgaagaatcgtttttctttacaattaaatgaaaacgcttttcttatcagggaggttggagaacatgatttcacgagaggcaaaagaagcgttcatccggacggtcgggaaggagaattatgatgattcggcggctggccgtcttgtgtattcttacgatgcggctcctcagctgcaagccatgccggatgcggtaatcgctccccgcagcgcggatgacgtgtcccgtatattaacgatttgcagcaggcatgacattccgatcgtgccgaggggttcaggcacaaacttatgcggcggcacatgtccgtctgaaggcgggcttgtgcttttattcaaacatatgaaccgcattcttgaaatcgatgaagaaaatttgacggcaaccgtccagccgggcgtgatcacgcaagatatgattcatgcggttgaacggaaagggttattttatccgcctgatccgagcagcatgaaaatatcgacgatcggcgggaatattaatgaaaattccggcgggctgcgcggtttgaagtacggcgtcacccgggattatgtcctcggccttgaagccgtcttggcttcaggcgatatcatccgcacaggagggaagctgacaaaggatgtcgccggttatgatctgacccggcttttcgtcggatcagaaggtacgctcggcgttgtgacggaagcgactttaaagctggttccgaagccggaaacgaaaaaaacgctgcttgcactctatgaacatattgaagcggctgcggaatctgtttctgccatcatcgctgaaaaaatcattccggcgacactcgaatttctggatcagccgacactgcaggtcattgaagattacgccaagatcgggcttccgaccgatgcaaaagcggtgctgctgatcgaacaggacggtgacatcgaaacggtcagacgagatatggaaaaaatcgaagccatctgtaaaaacggagcagccgtatccgtccaaacggccgaaaccgaggaagaggcattcgcgcttacagaggccagacggtccgcattatcagcccttgcccggctgaaaccgacgacgattctggaagacgcgaccgtgccgagatcacaaattgccggcatggtcaaagccattaacgagattgcagaaacatacggcctgtccatctgcacattcggccatgccggagacggcaacctccatccgacgtgcaccaccgatatccgaaatacagaggagatggagcgtgtcgaaaaagcttttgccgccatttttgaaaaagcgattgagctgggcgggacgataacgggtgaacacggggtcggcatcgtaaaagcgccgtatttagaaatgaagctgaaaacagaaggcattaccgccatgaaagcgatcaaacaagcgcttgatccccaaaacctgctgaatccgggaaaaatattcgccaattcatcaaggaaacgcgtggtgatgatgaaatgacaacggctaaagagcagcaacacattcaaacagaattcaaaaaccgcatggatgaaggtgaattgctgaactgtatgcgctgcggcttctgccttccttcctgtccgacctatatcgaatcaggatttcaagaatcccattcgccgcgcggccggatcgccctgatgaaagccgtcacagacggactgatcgaaccggatgaagatgtcgagcgttcactttcgctgtgtctcggatgccgggcatgcgagcccgtttgtccggcaggggtcaattacggacagctgcttgaagaagcgagggatatcattcatcaaaataaaaaacataagccgggtgtgcgcctcttgcggaaagccgcattcaccgggcttttccctcatcaaaaccgcatgcaggcagccgtgaatcttctcggaatataccaaagatcgggactgcagaccgccatcagaaaaaccggtatgctgcgcgttttgcctgaacatctgcgcacaatggaacaagtgctcccgcccgccccgaaacggaaagacatgaaggaaaggccgcgttttcttcctgccgcgggtcccgtccaaaaacgggccgcttttttctcgggctgcttaatggatacgatgtttttagcaacaaatcatgcgacaacggcgcttttacaggcggccgggtgtgaaatcgcggttccggacggccaggcgtgctgcggcgcgcttcacgggcacagcggagaaaaagagatgggaaaagaactggccaagcggaatatcgccgcttttgaggcgcttgacgctgattatatcattacaaacgccggcggatgcggcgcctttcttcaggaatatccgcatttactgaaagatgaacctggatgggcggaacgtgccgaacaattcgtccggaagctcaaagacttttcatccgtactggttgatctgaagttccatcaaaaaaacctgcgggcgcagtctcctcatatcgtcacatatcaggactcctgccatctccgcaatgtgatgcatacgtcagaagaaccgcgcacgcttttgaaaagcattaaaggggctgagtacagagaaatggaaaaggccgacagctgctgcgggtcggcgggaatttataatataacagagtcagaaatgtctatgaaaatattagacagcaagatgaaagccgccggaaaaacggaggcggccgtcatcgtaacagccaatcccggatgccttctgcaaatgcagctcggcattttacgcgaaggattaacaggccgtgtccgcgcggttcatttggcggattaccttttggaagcggcggatttgtcataagccgaaagcagagagaccgatcggctctctgcttttatgatgctgcaatgttcggatcggccgcggatttatccgggtattgaagcttccagtctggcactcggatcatgccatacattcgcccattttttcacagccgcaatgataatcacaagcccgagaatcagcatgataatggataaaacgccattcagcacgctgtatcccgccgcttcggggttcaaatacacataccgcaccatccaataacccgcatagttgacggtcacgtacaaataagcgagaggaatcaggcatgtcagcatatagcgccgcttatccgctatttttaatacgacggtcgcaccgatgattaagccgacagatgccataagctgattggatacgccgaacagcgcccaaatggaactgatgtcgcccgaatacagaagatagccccacagcaggcaggcgagcgcgcttgagaaaatcgagcccggcagccagtctgtttttttcagcggcttatagacctctccgaaaaactcttgaatcaagtaccgggcgacacgggttcccgcatcaatcgccgttaaaataaacaccgcttcaaacataatgacgaattgaaaaaagtatgaagccaaatgactgaaaaacggaatctccgtaaagatatacgtcattccgacggcaagcgtaacggctccgcccgttcttccttccagactgagcccgatttctttactcaattcaggcagatggacgacattcatcccgagggcgcggaatatttcaggcgtgctgttaatggcaaaatagtcggcgggctcaagagcggcagctgcaatgagcgccataattccgacgagacattccacaagcatcgctccgaaagcaaccggttttatatcactccatttatccagcattttcggcgttgtgccggaaccgacaaatgcatgaaagcccgaaatggcgccgcaggcaatcgttattgaaataaacggccagacaggacccgcgatcaccggccctccgccgtgaataaactccgttacggccgggaatttaatggcgggattgacgaaaaagacgcctgcgatcaaagcggcaaaaaccccgattttcataaaactgcttaaatagtcacgcggagccagcaaaagccaaaccggaagcgccgcagcgaaaaacgcatagacgggaagcaccactgcaagcgttttcgcatccagtgtcagcatgtccccgagagccgttgtctgcagccgcggcccgattacaacaccggccattaacaaaagaaacccgacagttgatgcgagtttgagattgcccgtttttttatagtagaggccgacccccatcgcgatcggaatcgtaatccccaccgcaaacgttccccacgggtttttctcaagcgcgtgcagcacaaccatggacagccccgccatcgtgatcgtaatgataaacagcatcgaaagaccggtgcaaaagcccgccaccgggccgagctcttctttggcgacttcagaaagcgttttcccgtttttccgcattgatgcaaacaatacgacaatatcgtgcacggctcccccgatcaccgctccgattaacagccataaaagcccgggcagatagccgaactgagctgccagaatcggtccgacaagcgggccggcagcggcgattgccgcgaagtggtggccgaatgacacccacttattcgtgggcacataatctttcccatcctcaagcacatgggccggagtcggtgtctgatcattgatttttaatactttgaccatcataaaggtaccgtaaagccgataggcgatcgccaaaatacatatagacgctatgacgattgtaatcgcattcatttaatcccagccccttttctctttttctaaatattatcacaattatcagataacaggagatgatttttgcgtaaaaaaaagccggcagcggcagcccggcttttcggaacattattttcctgataaacggatgacattccaggacagcggagtaaaatgtgccgttatcccttcagcgtttgccgaagacgttccgttggagtgaggaatgacttcttttctgtttttttgattggttgctttcatatcctgatgctccagcacgatatgctcaatgatacggtaatcttcaaaccctctcaatttgatctccgtttccatcagttccttgcttttgttgacggcaaaaatggtcagtgcttcatcctcttcatggtaaacggccgcggcatcaacatacggcacatccgtaaaatccgccgagtcgtatttcggggaggtgatcagcagcttcatcgaagtccctctcccgtagactgaggcgtgcatgtaagggtaaaagatcggctgcctccatgcttctccgcccttttcagtcatgataggcgcaatcacgttgacaagctgggcgagacaggcgatcttcagtctgtccgcatgctgcagcatcgtaatcagcagtgaaccgatcaacagcgcatcttcaaaattgtagatgtcttcgagaatcggccgggccgtaatccatggctccacttttttatccgcttcatttgagtgataccacacattccattcatctaaagaaaggtgaatcgtttttttgctgcgttttttcgctttcatataatcacatacggctgtgacggatttaataaaatggtctaaatccatagacttcgccaaatagttctcaagatcattttcatggttgccgtaatacgtatgcagtgaaatgtaatccacatgctcgtacgtatgctcaagcacctcggcctcccactcgatgaaggacggcatgccgctgtttgagcttccgcaagccaccaattcgatcgtcgggtccgtccatttcatcacctttgctgtttcagcggcaagccgtccgtattcatgcgccgttttatgaccgatctgccaagggccgtccatctcatttcctaagcaccatgttttgatgccgtaaggtttttcatatccgtgcgattttcgtaagtcgctccagtatgacccttcaggatggttgcagtattcgacgaggttccgggcggcatcgattcctctcgtcccgagattgaccgccatattcacttcggcgttcacttttttcgcccacgttaaaaattcattcgtccccacttcgttcgtttctgtcgtctgccatgccaaatcaagcctccgcgggcggttcttcaacggcccgacgccgtcctcccaattgtagcctgagagaaaattccctcccggatagcggatgaacggcacttgcaattccttgattaactcctgcacgtctgttctgaaaccgtccttgtcggctttcgggtgtccgggctcataaatgccttcatacaccgcccggcccatatgttctataaaagatccgtacatccgtttgtccacttcaccgatgatatattctttatctgctgtaatccccgcttttttcattacatttcctccctctctctatcccttcactccgcctactgtgaggccggaaatgaagtatttttgaaaaaacaagaatatgatgatcaccggcagtatcgcaaaaacggacccggaaatcagcatgtcatagttgttgccgtacggactcagcagccctgaaagtccgattggaagcgtaaacatttctttcgaccgaagcacgatcagcggccataaaaagttattccagctgtttaaagattgaagaatgatcattgctccgaatgccggtttcatgagcggcgccataattctgaagaaaatgccgaattcggtgcagccgtccattctcgctgaatcaagcagatctttcggaagtccgagcgcatattgccggaaaaagaacacggcgacaggcgacacaataaacggcagaatcacccctgtataagaatcgattaaatgaagacccaccgtcaatttgaacaacgggagcatcatcacttcaagaggcaccatcataatgatcagcacaagaacgaaaataatatttctgcctttaaactcgtagacaccgagtccgtagccgatcaaagaggaaaaaaacagcgtgagaaccgtggtgaggacgccgagcagcaggctgttaaaaaaccatttaaaataaatgctccccccgttgaacaaataggtgtagttatcaaggctcatcacatccggatcaagacgcagattcagcccgatgcgcatcagctcagatgacggctttaatgaaccgagcaatagacagatcatcggaaagatatacaacaggctcagcatgataaaaaacaaggtaaacgcgactctgtacacggaaaacatgtgattgttacgcaacgcttatccctcccctttaaacgaaccggacagtttcagtgaaacaaggctgactagtaagatgacaagcaaaaggacaattccgattgctgccccgtaccccatttcgttgtatgcaagcccctgctgatataaataaccgacaagcgtgaggccgatattgcccggggaattattctgccaaagcacatagctttcctcaaacattctgaaaccgccgatcatactgatcgttaacacataaacggacaccggctttaaaaatggaagggtgatatgccggaactttttccacgtactcgccccgtcaatttcagccgcctcatacaattctttcggcacattttgcaaacccgccagaaagtaaagaatgttaatccccatccacctccatgacgcaagcagcaccattaaaaacatgccggtacctttgttgttgagccagttttggggtgatgcgccaagcttcatcatcagctcgtttgcaagcgacgtattcatttctccgaacatcagccggaaaataatccccgctacgatcgtcgatgttaaagccggtacaaacagagccgatttaaacacatttctgaacctgacgagctttgaattcagaatcaccgctaaaagaagcggcaccggaatcagcacgatcagcgtccagaaggtatattccaatgtgttaaataatgccgtataaaaggttggattaagaagagcggtataattggaaaacccgacaaatgtaatttctcccggcagtatccgctgaaagctcatgataaacacgctgatgatcggatacaaaaagaaaacgagaaacgaaatgataaatggcgccgtaaaaagataaggcgccgctttttttgaatacagcacattgcgccggcgcggcttcttccggactgcagaaacggtttgcgctgtctctgtctttacaggtctcataaaagctcccccgctttcactgttaaatagggcggcttctcctatttttctaattgctctgccgcctcgtccaaggcttcctcaggtgttttttcctgcgtcttcagcgcatcgaacagcacctgtctgacaacgagatcagccgctttagagaagtcttcgtgcagataaatcggattgatctcatcttttatttcaaggagcgaggaaaaaattgacgtaccgttccggaagaaatccgtgtacttgtttttctccttcaattcttttgaatcccacacgtcccagcggagcgggtcaaagccgagcaccgtccacagctttatgttcccttcctttgaacctttcgcaaatccgagaaattctttcgcgagctccagatgttcagcctgcttcggcacgacggtggctgttccgcctaaacccgctgatctgtcaccgccttctttccaggccggcatagggtaaatcgccatttttccttttaaatcaggcatataatcgataaaccgtcccatgtaccaaatgggcatcagcactgaggctgccccgccctgattcataaaaccgtagtattcttcgctgtgatggccgccgccgggagccggcagaagggttttatcatttaccatgtcctttacatcattcagtgtatctgtattcgtcttgctgttcagaatcaattttccgtttttgctgtagtagcctgacccttgctgcgaaatcatggataggaatgtggcggagtcgtttgtttcaaccgttcccatcggtttcccagcggcttcacgcactttttttcctgcccgccggtaatcttcccatctcttaatggaggcgggatcaacgcccgcttttttcatgatatccatgttgtaaaacatgacggtcgtccccacatgtgtatcaaggccgtacaattttccgtttttgctgtagtagcctgacccttgctgcgaaatcatggataggaatgtggcggagtcgtttgtttcaaccgttcccatcggtttcccagcggcttcacgcactttttttcctgcccgccggtaatcttcccatctcttaatggaggcgggatcaacgcccgcttttttcatgatatccatgttgtaaaacatgacggtcgtccccacatgtgtatcaaggccgtacaattttccgtttttgctgtagtagcctgacccttgctgcgaaatcatggataggaatgtggcggagtcgtttgtttcaaccgttcccatcggtttcccagcggcttcacgcactttttttcctgcccgccggtaatcttcccatctcttaatggaggcgggatcaacgcccgcttttttcatgatatccatgttgtaaaacatgacggtcgtccccacatgtgtatcaaggccgtacaattttccgtttttgctgtataaggccagacgcgcttccacaaacttatcgcggtctttttcaatcagcggcgtcagatcggcaagcgggatatccttccccttcagaaagttcgagaaccggcttaattccacgtcggctatatcgggaagcccctcacccgcgatcagcgaaaccgataaattatcatgcatttgtccataaggataaacaacggtattcagcttgattttgcgatccggatacttctgattccattctttgaccatttcctgataaaactgttcgtgcagaccgttaaacgtccaaaacgtcagctccgtttctcccggccggccggcagtccgttcttgtgaacagccggcggtaaacaagaagagcatcatcagcaccaaacatacagcggtcgtttttttcatgtcattaccccttccactttaggccgtgcggctattgatgcaaatgatgtgcaaagagcgctgcattttcatttatgatggttaaaccggtataacggtctcgcagtgtgtgcgcatgcttaagtgcatcgctgacaaggtccttttttacaccgatctcatcgaaacaggcgggacctcccgcagaggagagccacccggcaattgttttgccgtcgggaagcccttcatatgcggactgaatcgcctcgcgaaagtgcggcggcagttcagcaagcttttcgtgacaagccagttctttgtaaatatcactcagcaccgcgcacgcacagccgaccttcgcaccgtggagaatcggaggctgttttgccttcagcatttccatctcaatccaatgcgagatgtgatgctctcctcctgaggcggggcgggagtggtcaagagcaagcatgacaagacccgaaacgatcagcgcttccatcagtatctgaatgccggcctccgttcccatggcaatgtcagcgcggtgatcaatgcactgccaaagcgcgtctttcacaagcttcgccccggcttctgagtacggctcacccgcaaggctgcgggaaatctcccaatcagccagcgatgttattttcccgagcatgtcaccgaagcccgcggctgtcattgaacggggcgcttcttttaatacattcgtatcggcaaataaggcgatgggcgctttcgtttgaatcgtcgttttgattccgtttaatatgagcggcgctcccgccgatgtaaaaccgtcgactgacggagcggtggggaatgagataaacggcaatctgcgctgataagcggcaaaccgcgtaatgtcgtgaatcgttcctgaaccggccgcaatgataacatccgtctcttccgcgagattgatcagcgtatagaccaatgtcctctcatcagccgcggcggccccggcttcatgctccggaatgatgacttttgacgctttgattccgcctgcccttaattcgtccgcaagcagacgtcccgccgcctcgtacgtgttccggtcacagacgatgaccggatgattccagcattttttttgcagaaatctgagaagctcttcttttgcattcgccccgatcacgatatcttctatttgaatcggtgagcggctggccccttccttgtcaaactcggattgaatgtcctcaggagaacgtttcataaaaggattccctccttcgctaattctgtcaggtctttaatagaatcaaggacgatgtcaggttcatatagacggggctccccaagtttggccgaccccgtcagaaccaatatgcttttcattccgtacagcctgcccattgcgatatcagattcgaggctgtctccgattatggcgcattcctcagggggaagtccgagcgcttcacatgccgcctcagccatcagccaagacggtttgccgatgacaagctccgtttttgctccggcggatgcttcaatggccccgatcattcccgcgacatccatggcatgaccgccttcattcggaaaggagcggtctttgttcgtggcgatgatgcgcgcgccggaggaagccgccttaaaagcgagattcagatccttataggtgacggtttcatgcagggagatgacaagccagtctgccgcctgcgggttttgcgccaggacgacacccgctaaagcgagttcatcagtcagccctttctctcctaacacccagacctttgacaaaggataatgcttctttaaaaatgatgccgtcacactggaggacagcacgatgctccgttcatccgtgcggataccggcacccagcagtttctttcggcacattgctcttgatagattgccgcggttgcttaaaaagacaacggctttgcccagtgactgaagggtatgaacggcttcttttgcgccgtcaatcagctcccgccccctgaatacggttccgtctaaatcaatcagaaacccggctgcgtcaagtttggccataataagcattcgccccgtgttttctgtaaaaatgcttatcatgcagcactctgtcgatcggactgagctgtttgttcagcataagcgaatggtaggccatttccgctaccgtttcgagcacaacggcgttatgcagggcattcagcgcgtccgtcccccagcagaacgggccgtggctgtggacgaggacacccggattttgttcatacggttcgttttgaaaggtttcggctataactttgcctgtatgatactcgtaatctttcacaatttcttcttcatacatttccctcgtgcagggtatagcgctttcaaagtaatccgcgtgagtcgttccgagagcgggtatgtctcttccggactgcgcccagctcgtcgcccagcgggagtgagtatgaacgattccgccgatagccggaaacgctttatacagataaagatgggtcggcgtgtcagaagacggtttcagcgagccttccaaaatgtctccgtcctcattcaggacgaccagtttgtcagcggtcagctcactgtaatcgacaccgctcggtttaatgacgattctcccgctctctctgtcaatgccgctgacattcccccatgtaaacgtgacaaggttatgttcctcaagcttcagattggcggcgagcacttcttcttttaaagcttcaagcatggcggctcccccctttcgcaaaatcacggtttttaatggctttcaggcgtttcatgacattgttttctttgccgaagtagtgtacgagctctttatattccgcatataagctgtcataaatctcagctctttcccggttcggggcataaaagccgtcttttaatttccccatatgcgcgcatgcttcagcaatattggagaatcctccgttttcccgtcccgcggcgagcgctccgaaaatcgcggagcccagtgcaggtgcctgcggagatccggataattgaatgtccatatttgtgacgtctgcgtaaatctgcatgataaacggatttttttcggcgattcctccggctgcgtaaagctcttcgaccggaacgccgttttcccggaacgtttcgataatcatccttgttccgaacgccgtcgcttcaatcaatgccctgtagatttcttcgggcttcgtgtgcagcgtcatgccgagcatcatgcccgtcaaatcggcgtccaccaaggttgaccggtttccgttccaccagtcaagcgcgagaaggccgctttccccgggaacaagttctgctgcttttttgctgagcagctcgtgaatgtctatgtgtttatcctcagcttccttctcatagtctctcggaacgcacgttttgacgaaccattcaaagtggtcgccgacacaggactgccccgcttcatatcccgcatatccgggcaaaatgccgttattgacgaccccgcacataccggggacgagatgttcttcctcgccgagcagcacatggcaggtagacgttcccatgatcatcagcattttccccggctctgtaataccgaccgcgggcactgacacatgagcgtcgacattggcgacggcaacggccgtccccggcagaagcccggtcagctccgccattttttcggtcaaacctcctgctttttccccgactgaataaatcgcgccgcttaatttatcctgtgtaatcgttttcattaacgggttgagcttttcgaaaaaatgatccggcggataccccgtctcctcattccagattgctttgtagccggccgtgcagttgcttcgcttcaatgaaccgcacaattgatagacgatccagtctgccgcttccacaatccgatctgccgccttgtatatatgcggcgcttcttccgcgatttgcatgattttcgggatcatccattcagaagaaattttaccgccgtatcttttaaggaatgtttcttttgtgtcttcggcaatcgtgttcaaacggtctgcatgtttttgagccgcatgatgcttccacagcttcacataactgtggggctcccgttcaaattccggcagcatacaaagcggctgccccgcgccgtctatcggtaaaatcgtgcaggcggtaaaatcaattcctatgccgatcacgtcttttggatcagcgcccgcctgctcaagcaggttcggaatcgccgtttccagaacttcgatataatcggcaggatgctgaagcgcccagtcccgagggagtttttcacccgtcttcggcagcgtgcggtcgatgacggcatgagtgtattcttttaccgcagacgcgatttcttcacccgtgcggacattgacaagcaccgcccggctggacaatgtgccgaaatcaacaccaatcgtatacgccatatcaattccctcccagccggtataatacgtcattccatttcagctcttttttcagctcatgtatttcggtattgcgggaaataaagatgctttcaatgcctgccatctcagcccagtcaagcatctgttcagccgtaagccggaaggacatacaggtatggtgggcgcctcccgccaaaatccacgcttccgcagctgttttcagcgatggctccggcttccacagcacccgcgccacagggagattcggcatatcatgatcaatttccctgccttccgcttcattcagaatgagacggaaccgcccgccgatatcaatgatgctggcgatgatggctgaaccgccgattccgttaaaaaccagccgggccggatcttccttccctccgattgagagagggtagacttcgattttcggctgatcaagggcgatcgtcggacatacttcaagcatatgtgatccgagaatcatcgcacgacccggttcaaaatggtacgtataatcttccatgaaggaggtttgttctccgtccgccattattttcatcattcgcacaagggcagccgttttccaatcgccttcgccggcaaatccgtaccctttttccatgagacgctgaacggcaagacccggaagctgcttcattccgtgcaaaacttcaaaggaggtcgaaaacgctgtatatccgccccgttcgagaaaggccgttaatccgagttcaattttcgcctgttctttaatggaagcaacttttgcttcatcccgcttcgtttcgtcgctgatgacatacaatttgtcgtattcctcataaagcgcctcaatttctgcgtcggtgacattgttcatcacctcggtaagatcgccgattccgtacccgtcaacctgccagccgaattgaatgtgggcgccgactttgtctccgtcagtaaccgccacattccgcatattgtcgccgaaccgggctactttaatattcctgctttcattccaagcggcagccgtgttcatccattgcgaaatgtcatgtttgacttcctcatcatcccaatagcctgcgatgacttttctcgtctgccccattcttgactggatatatccgtactcccggtctccgtgagcggattggttgctgttcataaagtccatatcaatcgtttcccacgggatgtcgcgatgatactgggtatgcagatgaagcatcggcttttgaaaagcggaaagaccttcaatccacattttcgcaggggaaaatgtatgcatccatgtcacgaccccggcacagttttcttgatactgcgcttcccgcaaaacctctctgatcgtttcagatgacgtgacaaccggtttatgcctgatcttgtatcttgatgacaccccgctgagaccgtcacatattccctttgcgtgtttatcgacaagctgcagcgtttcctctccgtataagtgctggcttcccgttacaaaccaaaattcatattctttgttctgaagcacattcatttccccttcccatcaaaataaagcgcttgcatttttaaataaatatacgtacgaatgtaaataataaaacttttattcttttatttgtacgaacaactttattatagttaaggaggaatcaaactgtcaatcttttattgcaagtaaaaaagccggacacacatgcccggctgatcaattaataggaaggccagcctgaactccaatcgatatcattgatgagcatcttcggaattccgctgttttcggcatcatacgcatgacgcactaaaatattcccgttcacaatgtcttgaccgcccgggcctttccagcggtcattgccggaatcaagaatcgtccctccgccttcagacatgcttttcccgcttttatcgagatatgggccggtgatgcttttggatcttccataagcgattttgtacgtactattcacccctgaacagcatttatcaaacgacaccattaagtaatagtagccgttctggtaggtgatggccggcgcttccaaagctccgccgttattcggtctggcagcgatggaataaagtgatcccgtcggtttcattgtatttttatcaagctttgtcagcttaatgccgctccaaaaagaaccgaaggcaagccaagggtttccgtctttatcaattgtcagctccggatcaattgcattgtagttattggcgcttgtcgaacggatgacaagcccttcgtccttccagtttcccgaactgaggcttgtagatgatgcaagaccgatcgcggaggtatttttgccgaatgaagaaacggcataatacagccaatactttccgttaaaatattgaacatcgggggcccattgattcagcccgtaattcggcacataattgccccaccatgacagcggggaagtaaagattgatttctgaacggtccatacgccgccgctgcccgcctttaagacgcgaagccccctctccccttccaaaccggttccgaaagcgtaccacgtgtttccttccttcgccattgtcggatcgtgaagcaattcatttgatgccccccaaaacgcggcagatgccggagatgaagacatcatcagcagcccggctgtaacggctgcgcacgaaaagcggatcatgcgtctgaatctgtttttcatttgtaaatcctccccttttttaaagcgctttcaaaaacatgttgtcagatttttctatgtcttttcttattgtagacgcaaggctcatatttgtacagacaaaaaaaagaatctgcttaaaaaagcagattcttccgtatctttattgataagtaatacggtcaaccgtttcccggtctaattttttaatcacttctgtgatcaattttaccgtattctcataatcatcccgatgcaaaatagcggcatgagtgtgaatgtagcgcgtcgcgatcgtaatggacagcgccggcactccgtttgcggttaaatgaatggaacctgaatccgtgccccctccggcaatggaatcgaattgatacggaattcccgcttcttccgccgtgttcacaacaaggtcgcgcagccctttgtgagataccattgacgcgtcatacagaataatttgcggcccttcgccgattttgctttgcgcctctttttcagaaattcccggtgtatctccggcaattccgacatccacgccgaacgcgatatcaggctggatcgtatgtgccgctgttttcgccccgcgcagcccgacttcttcttgaaccgttccgaccccatatacttcattcgggtgatcactgtttttcagattttttaatacatcgatggcaatcgcacagccgatacggttgtcccatgctttcgccaataaatgcttttcattgttcatcactgtaaattcaaaatacggcacaatctggtcacccggaagaacgccccattccattgcttcttcacggctggacgccccgatatcgatgaacatctctttaatatcagcggctttttttctggcgtcaggaggcagaatgtgaggcggtttcgaaccgatgatccccgtgatgtcccctttttttgtcacgacggtgacgcgctgggccagcatgacctgagaccaccagccgccgacggtttgaaagcggagaaagcctttatcagtgatttgcgtcaccataaaaccgacttcgtctaaatgccctgagatcatgattttcggaccgttttctttgccggtttttttggcgattaaacttcccagccggtctgttgtaacatcatcggcaaatggttctatgtatgatttcatcacttgtcttacttctctctcatttcccggtatcccttttgcatccgttaacgctttcagcatggtgagcgtttcatctaaatttgtcatcaataaacctcctttttttcactacccttcttattatacaaaaccaatgctgaagcatacgattaattcgcctgaaaaacgggtaaatgtttttatctatttcttttaaaaaaatgaaactttttgttttgtttttcgtattacatcagatcatgacaaaggtgaggaggtgccttcacacatatggccattacagtattgaggattgtcttgcttgcacttcttatttattttatttacatgtgcgtcaaattttacgcaaacccgaaaagaaggctcagactggcgcaatcaaaagagaatttttattttattgacgaacagaaaaacacgcgaaaaaatctccagcttacttataaaggagtgctctttgaaggagaaaagcatatcccttccaaagatcatccgctgtttatccatacaatatttgtatggaccgaaaatccggaaaagctgaaccgcttttctgcagatgattttgaagaagtcgaaaaaaaggtattggagcggtatccgaattgcaagattgattgggaccagcccatcaaaaaagcgaaaaaagcaggcgagcgataagctctcctgctttttattttttatacatcaaatacatgagcacaagggcggcttcagtgagaaaaagcagcggcaccccgtataaaaaggatttgtgcttcgtcttatgcctgaaggtgcgcatgccgatccatacgccgagtgagccgaacatggcggctgtgagccatattcgtttctctgatattctccacctgtgcgcctttgctcttcttttatcagcgcccatgatccaaaagccgtatccgtttatcaatacggcgtaaatgaagagagccattgattgtcaccctttacgtaaaaaaaccgctcccggaaagagagcggctttttcaacttacttgtctaactgagctttagcagcatcagcaagctgattgaaagcagtaagatcgtttacagcaagatcagcaagcattttgcggtttacttcgatgcctgaaagcttaagaccgtgcattaaacggctgtaagaaagaccgttcatacgtgcagcagcgttgatacgagtgatccaaagcttacggaaatcacgttttttctgacggcggtcacggaatgcatagtttcctgatttcatgacctgctggtttgctactttgtataatgtatgttttgaaccgaaataaccttttgctaatttaagaacctttttacgacgcttacgtgtaacagttccgccttttactcttggcattagatttccctcctaattgttccttgtccgattacttgatgttggcaagctgttgtttgatgcgtttgaagtctcctgcgctcacaatagcacccttgcgaagcttacgcttttgcttttgggatttgttggcgaataagtgacttgtgtatgcatgagaacgttttaacttcccagaacctgtctttttaaaacgtttagcagatccgcggtgagttttcatttttggcatgggatttcctccttattgcttttcgtttttcggcgcgagcattaagaacatgctgcggccgtccatttttggttttgtttcgactgtcgcaacttccgcacatgcttcagagaaacggtccaatacgcgctggccgatttctttatgagtgattgcgcgccctttaaagcggatagaagctttcactttatcgcctttttcaaggaatttaatcgcattgcgcaatttcgtgttaaagtcatgctcatcgatcgtcggacttaatctaacttcttttaagttaatgattttttgatttttgcgtgcttctttgtcctttttctgctgctcgaatcggaacttaccgtagtccatgatgcggcagacaggcggttttgcatttgctgcaactaacacaaggtcaagatttgcgcggccggcgatttcaagtgcttcctgacgggacttgatgccgagctgatcgccattttgtccgatcagacgaacttcacgtgcacggataccctcattaaccaattgatctttgctaataatgagccacctccatagtttcttcgaattgattcacaacgctttttgactgcattctgcaggcaaacaaaaagtgcgggcatgacaacacacccacactacgaacatctgcataaataaaaatgtacggtcaacctgccaactacatgaatgtgtcaatcaggtgagaagcgggtgcctctgcttgtgatttatattcaattcaataactattctacacaataccggatcattagtcaagaatgacttctccggatcaactttttcattttaacacgatgccggggtgagcgcaaggaaaaatgtgaaatttcgttctttgccgcccgcggacgtgccaacacaataaaaaacccgggtctatgacccgggtttatcctccgatgagctgaacgaataccggaatgaccagcaccgtcaccactcctacgacgacaaccgcgatacttgccattgccgcttctacttcccccatctcaatgccgaccgcaacaccgagtgcgtgtcctgatgtgccgagagccagtcccttagagattgggtgctttactttaaacagttttaagaataaagcgccaagagcatagacgataacggcgttgaaaataacggcgaaagcggtgatgtcggtgatgccgccgatcccttttgacagcggaagggcaattgccgttgtcgccgcctgcggaagcatgcttttcataacggccgcgtcgagatgaatgccttttgcgatcaaatagacaatcgtgactgagcagatagagccgacaatgatggaagacatgatctgccaccagtattttttcagcttggcacgctgtttgtataaagggatggcaaaagcgatcgtcgcgggctccaggaagaatttaataatgtctcctccgcttttataatcttcatacgaaaaaccgccgagcttcagaaaaagaattccaagcaccatcgcaacaaacagcggggtgaagaggaaaaagcctctcgtttttttaaataaatacgtgccgatgccaaaggccgcaagtgaaacgacaataccgaaatatggactcatccgttttccctcctaatgctgcacaagttcgttttcctgattggaacggcgcaccgtttgtttatcagccggagcagccttctgacgtttttggctgacagacaagatcagctgagaaaaaaggcctgtcgcccctaacagaatgatggtggcgagtaagatgacgagtgcgatctgcacgccgtactgctgcatgacgccaagtgaattcatcacggagatgcccgacgggacaaataaaaatccgatcagtgacgttaatgatgttcccagcgtttctacttgttcaagcttaatcactttcaggcataagaggacaaataataacaccaaacctactacggaagcgggtataggaatggggacaatcgctgcaatcccattagatatgagcataattacggcaaaaataaatgcttgtgtcagaaatccgtacacttttttcgcactcattttcttcacctctttctctttgttaggtccattataaaagagaaatcgatttttaaagcgctttcataacaaacggctgaatattcattctgaaatgcaaaaaacggctgctgaaatgcaaaagccgcctcatataatatgaagcagcttttttaagtcctttgcgtatgtacggctgacgggaattttagagccgtcttttaagatcagattgtaagtcgaattaaaccacggatgaatttccgtaatatgctccgtattcacgatgaacgcgcggtgcactctcaagaaacccgtatcaggcagttttttctcaatgaccgccaaagtttcatgaacggaataagacgcggcaaacgttttgacggaaacgtgtccgtcctccatgccggcgtaaataatgtccttcgtatctaaaatgacaatagattcaccggctgatacagccagtttatgcgctccggctgcggacggctgctccgagacggctcctgccctgtcctgcttcactcttttaaactttctgatcgtctggcgcactctttcttcatcaaaaggcttcgttaaataatcgagtgcgtcgacttcaaaagcttttaaagcaaattggtcatacgccgtcgcaaaaacgacggccggcggatttttcatgtttttcagccgtttggcaatatcaaatccgttttctcctgacaaatcaacgtccaaaaacagcagatccggtttttgatccatcatactgtcaaaagcggattcaatattttcagcttcgtttatgtcacttacttcattcgtccgtttcagcaaataagctaattcatctcttgccagcatttcatcatcaacgattaacaccttcagcatgttcttctcctttagtcatcagtttcaaaggcagctcaaatgatacgtccgtacctttgccggtctcactttccaatcgcagggctgccttggggccgaacagcccgatcagccgctgatttaaattgtaaagcgcagttcccgtcccttctttagacgggagcggacggtttccgagcacggacagcaattccggatcaattccccgcccgttatctccaacccgcattaaaaccgactgaccggcggataccacgctcacattgacggcacagctgtcctgctttcttgaaaatgcatggcgaagcgcattttcgacgagaatctgcagcacaaaaggaggaatttcgatgtcctccaaaccgcgttcgatttcaagactgattttatatttcccgggaaaacgggcctgctccaatgataaatacgcctgcagatggttcagttctttagaaagcgggatgagcagctgccttgccccctggagattggaacggaaatagacgctgagctgcagcagaagctttcgggttttttctacatccgtacggcaaagagcagaaatcgtattgatcgcattaaacagaaaatgcggattgacctgtgcttgaagcgcttttatttctgcgtctttcagcaatttgctctgcagttccgcctcgccgagttcaagctgtgtggaaaacagcatggcgagtccttctgcaagctcttcttcaacccggcttaaacctgacgggcttttaaagtacattttcagcgtcccgatcgttttgccgtttgacgtcagcggcaatacaatcgccgcatgcagcggacagggatcgtgcgtgcattcaatttcttcctttgatgtcgctttcataatatgacccgttttaatgacgcgttttgacaatccggtaatcaggctttcagacggaatatgatggtcggcacccgcgccgacgtgcgccaaaatcttttcgttatccgtaagcgataccgcgtccgttcctgtttgcctgtggatgatggcagcgacgcttttgcatgagctttcattcagcccctggcggaaatacggaagcgtctgatcggcaatcatcagcaccctgtgggtttcaagggctctcgcccgttcttccttccggataatcgactgaatgatcgaaagaaaaataaaagtccctgacccgtttaccaatatcatcgggatgccgatgatgctcacaagcgtccaagcatcagaaaacggcttggccatcaagaggatgagcagcatttgcagcgattccattccgagtccgacaagcgcggccacacgcggtgtcggcatcctgtagcgttttctgaaataccgtccgatccagccggacaaaatgccagctaaaacggatgagacggcacagctgactgcggtcgcgccgccgagtgataaacgatgcaggccggccagtatgccgacgccgatccccacatacggaccgcctaagagtccgccgatttcaacgcccataattcttgtattggcaattgaaccggacggattaatttgaaacacccagtcattattcatgattgtattctgctgaatttctattcccgtatagttgctgatgatactgaacagcgagaaaattgaaatcagcaccgctttgcctttatagctctcaggctgctggagcgcctgtctgaacaatctggtatgagccagaacaaatcccaatatgacgataattccgactctttccagcatcatgatgatcaaatgcagcatacttttcacctgttctttcaaattttattttatcacgttttagagcccgagacagaatctgacacaaacctgcctgtttttttcaaatcatctgaaaacaaatctttcacagtctatgtatctattgtagaataaacgggagccttgcggcagagagtttcagaatataacaaagaggagaagatcatgaaagccgtattttttgatttggacgatacactgttatgggatgaaaaaagcgtcagaacaacattcagggaaacatgtttacaagcggaaaaaaaatatggccttgacccgcaaacatttgaagaggcggtacggaaagcggcacgggaattgtatatgtcatacgaaacctatccttatacggtcatgatcggcattaatccgtttgaaggattatgggcgaatttttccgagccggtcagcgaaggatttaaacagctgaatcggattgcgccggaatacagacgaaacgcctggacgaacggcttaaaaagcgtcggtatagacgatgcggcttacggcgaatatttggcggagtttttcgcggcggaacgcagacagcgcccgtatgtgtatgatgaaacgtttgcggtgcttgataagctgaaaggtgtttatgaattgcttctgctgacaaacggcgatcccagcctgcagaaagaaaaactagccggcgttcctgagctcgcgccttattttaatgaaatcgtcatctcaggcgctttcggaaaagggaaacccgatgcctccatattcgaacattgcctcggcctcctgaacctgaaaaaagaagacgccattatggtcggagataacctcaatactgatatattgggagcgaaacgggcaggcattacgacagtctgggtaaaccggacacaaaagaaaaatgatacggacattgcgcctgattacgtgatcagcgatcttcacgagctgtttgcgattatagagaaacaaaaagaaagataattttatacgcaaaaaaaccccattctgaatgaacggggttttttgtatttccggttattttttcgcttctgctacagcctttttcacaaaatcgtccaatgagacggtttctgatttctgctcgccgtatttccggacgtttaccgcgccgttttccgcttcttggtcaccgaccacaagcatgtacgggattttttgcatttgcgcttcacggattttatagccgattttttcgtcccggctgtcaagctcgacacgcaggccttcgcgctgcaggcgctcctgcacttttttcgcgtagtcaagatgcacggacggtgatacaggaatgacttggaattgcaccggcgcaagccatgtcggaagggcgcctttgtgctcttcgattaagaaagcaacgaaacgctccatcgttgatacgacgccgcggtgaataacgacagggcggtgctgtttgccgtcttctccgacgtaagtgagatcaaagcgttccggaagaaggaagtcaagctgtacagttgacaatgtctcttctttgccgatcgccgttttcacctgcacgtcaagtttagggccgtaaaacgccgcttcgccttccgcttcataatagtcgtgccccatctcatccattgccgccttcagcatggattgcgctttgttccacatctcatcatcatcaaaatatttttccgtatcttcaggatcgcggtaagacaggcggaatgtgtaatcactcagtccgaagtcttcgtatacgtcttgaatcaaacggacggtgcggatgaattcttctttaatctgatcagggcggacgaaaatgtgcgcgtcatttaacgtcatgccgcgtacgcgctgaagacctgaaagcgccccggacatttcataacgatgcatcgttccgagctcggcgatgcggatcggaagctcgcggtagctgtgaatgtcctgtttgtaaatcatcatatggtgaggacagttcatcggacggagcacgagtgtttcattgtccatttccatcggagggaacattgtatcctgataatgatcccagtgccctgatgtttcgtacaggtctttgcttccgaggacaggcgtatacacatgctcataaccgaggctcagctctttatccacaatgtagcgctcgatcacgcggcggatggtcgcgcctttcggcagccagagcggcagaccttgtccgactttttgagagttggcaaacaattttaattctttgcccagttttcggtggtcacgctctttcgcttcttcaagcatgcgcaaatgctctttcaagtcatcctttttaaagaaagccgtgccgtaaatccgctgaagcatttggtttttgctgtcgccgcgccagtatgcgcccgcaaggctcagcagcttaaattctttaattttgcctgtagacggcacgtgcacgccgcggcacaggtcaaaaaattcgccctgctcataaatagagaccgtttcgtcttctggaatcgcatccagcagttcaagcttcagattatcgccgatttccgcaaacatggcttttgcttcatcacggctcacttcttttcggatgatcggcagattttcaccgatgatgcgtttcatttctttttcaatcttcggaaggtcatccggcgtcagcgcctgctccatttcaacgtcataatagaacccgttttcaatgacggggccgactccgaatttcacatctttataaatgcgtttaatcgcctgggccaataaatgcgccgtgctgtgccgcatgatgttcaaaccttcttctgtgccttctgtaatgatttctacggcaccgtcctcttgaatcggcgttcttaaatcaatttcctgtccgttcagttttccggctaaagactttttctttaatcccggactgatggatgccgcgatatcttctgttgttgttcctttcggaaattcctttaccgctccgtccggaaatgtgatgttgatcatatctgacatcttcgtcactcctttttttatgcaaatcaaaaaccccgccccctatgaaagggacgaggttaaataaacggaatcgtggttccacccttttttccgcgcggccgattgcttcggcactgcggctctaagctctgtaacgggagttcccgtcagctattactggcgcttattccggcgttcacagctgaagttcaaaggcggtaaagacaatgatccatagctggaaagctttcagcctgggctctcctctcttataaagccggtatcaatgcttcatgtccttatcaatacgtgtagcaatcattaatcttttatgtattataaaatgtctgtgagaaaaatgcaactcggttttccgtctgatttcgcacagacagccctgccgcttacacaaggccgtccgtgcggctatccttccgtcttctcggctgcaaacgcgcccagcggaaaaaggcgcaccctctcctgaaacacgttttgaatggttcttgacatcatatgttccggtttgtccgtatacagttcgaccgtctcaggcgcaatggagatcagcggcgcaaggagatgggaatctatatacatcgggtgctcccgcacaaaccgtctgtctatgtattttttctgttcccgttctgacacatagcgcagctcccacagcgtaaaagcccggtcatgtacgatgcggactttcttcatccgcggcggattggatgtcacataatctctcagagactggataaagttttgatattcctgttccatccggtattcatctatcgcggcctccgcatattctctgagcctctcataatacctgccgagccggaacgtctgaaacgaacgcacggaaaaaacacccgcatcaagtgaaatcgtccggagcgcatctgaaataaactgtgtgcgcggctctttcttcggctcaaacggatgatcctcaagctctccttccataatgctgtgtgcaagctgaaggatttgctgctgttcatcctgatcggtgaagcagtatgcgtcctcaataagcgaaagcatatgctcgtcttctttgcattccaaaaaaaacctgacaagtatcggctcaataaagcgctgaacgcaaaaagccgtttcagaccttgcgattccgactttttttatgccttcacggacaataaaatgtctccggtcgtccgattgctgaatgagatgtaaaaaagcggcggtatcgtggtcatcttcaaagatcacttcaagcatatttgtccccccttacggcatctgttacaagtatatgggggatgtttttaaaatagacgtaaaggttagctttcaccgccgaacaaatgacgcaccttctttttaaatataacgggaagcgataaaaatacgatgtaaagacagatcacacagagtacggtcagcacattgccggacataaagctcgcgccgagcacattcaggacgatcgtccccggaatgatgcccgctgcggtcgccaaaaaatacgttaccggcctgactttcgataggcccgcggcatagctgatcacatcaaagttaacaggcagaatgcgcaggataaaaatataaaagaagccattggttttcatctgcttttgaatggcttccatttttccatgacggcttttctcattaaaggcaaacagccccgccgcaaaaaaagacgcggcggcagcgcccattgagcccgccagcgtatacatggtgccgaaaaacgggccgaacgccaatcctccggcgacggaaacgattgatacgggaaacagcacaaaaggcctgacgatggaaattccgataaacacaagcggcgcaaaaacaccgaacgataacacccacagccggatctccttaggcgacagattcagatatttgcggtttgcccacagcaaaagacccgctcccgccgcagccgcagcccaagtgacagccttcttattcctcattccctcaaatccttcccattggacgccggcatcatgaacggcggcggttttccccgtcaagacggatgggcgaagccaaatataaaatccgctccatcagtcttgccgcttttacttcttccttttctccccgctgtgaatacgtaaaatgatgcttcagctcgtctggtgaaaaattagacgagaagaaagtgggaagctgctggctcattctgtgctgaagcacggtgccgatgacttcatccctgacccagcttgtcattgactccgctccgatgtcatcaagcatcagtacgggcgtcgttttcaccatattcagtttcgcctccagcgactgatcctgaagcgagtttttcagctctctgacaaattcgggaacatatacgatcattgatgaatactctttttccgccagttcgttggcaatggcggctaaaataaatgtctttccgattccgaattttccgtacagatacagccctttgccttttcccgtttcattatagctcttcagaaaatccgtcacatgctggaaaatgccgagtctgctcggatcggtaatgtcgatctgctgaaacgtcgcgccgagaagatcctgctggatatacatgctcttcatcagggacttttgccttttctggcggtcgagctttctcttttccggacattcgtaatattcaatatcaatggaacgcccgttgatcacaagcttcggatggtagccttcaagcaggctgttcgtccggctgtctttcgaacagaaggcgcactgtttgctttgctgaacgaattcgtacagtttatttaaccctctgtcaatcatgctttgattgataacatctttctgttccttcaaaaaagcctggacgtcttcgtcggccataacttgctgctgcattcgttccaggcgtttttgaaagtcaggtcttttcgtcacgccttctaaggatcggctgatcggttccattaaatatcaccccgcttctctgtctcaataggcagagtattttttcagttttttcatttcttccatcatttttttcttctgttcttcaagatcctgtgcggaaagagccgtctgttcttgtttcttcccggtttcttcttctttcatccaatcagggcgcttttcttcccggacggtttttttgccgcgcgccgcgccgtttgttttgccgtccgcccaatcaagatattgcctgtgctcttcgattgcgagcttcattgcttcccgtaccgttttgactttctttctggcccagtgggcggcgattttttggatatagtttttggacagcttcatatccgttttcagcatgacataataaatcagcacattggtgacgccgggctcaagcttttgttcgaacataatatcggcgataatctgcaggtcggcttttgacggctcggtcccgtccgcaatgtcctggagaagctttctcggtgatatggtctcaagctgtgcgatgagttcgccgttcaatgaatcgtccttttccgtccgattttctctcaaggtgacaggctgtgttttatcaatcagttcgggaagcttgccgcttctttcaatttggtaccagtcgctggccgctttcctcagcgcttcggccgttatcgtatcctgttcattaattgcggtcatgacgacgtgctgcatggaaataggatctattccgtataaatatgaaagctttttaatgctctcccgcacatcctgtgtgattgatttgcgcggtatcatcgtttctgataaccccgccaaaaacagctcaaaatcaaacacttcctccgtcaccgtataggatggcgcttgtccgacagacgccgtctcatagtcctcggggagcttcatcgcctcttccatatcaggcgtcattttccattcactcggctgaaaagaggcaaaagcgtgattaaacggacgggtaatttcccttgcgcccgcgccgacggaagggtgcgtgtaaaattgtctcagctgctggtatttcgttttaccgactctgttataaagaaagacattcagcatgccgtcttcaaaaaaatcattcggcctgagcgggggcagcagctcataaataaacatccgctctttttgctcggactcccggatatacactttcagcagtccgattccttcaagctttccctgttcatgatgaatcttttttaaatttgactgcatcatgcccatcagctgcctgtgcgtggattccgctccccacaagcggttctgctcaagctccccccacaaggtcatataaagggagaatgcaaaagaaccgatcagcggctggtacagatgtgtcaaaacctgtctgtcgacatcctgaagaagcgaacggcttttgaccgtataaggatctacaggcaatacgtcattccaatagtcagccatgattctcaaaccttccgatatgtttctactctcattttacaccgtttctgcgatctatcaaatgccaattttgctcatgagaaaagagccagacacaatctcttagctctctcagcgttctttctttattaaatctttcaattcatcgataaacacgtttatatccttaaactgccggtagacggaggcaaagcggacataagacacctcatcgattttcgccaggcggtccattaccatttcaccgacaagttcgcttttgacttcagatacgccttggtttctcagctctttttcaatgtcaaagcacatgtcttccaatgttttcaaaggaacgggccttttttcacaagctttaattaacccgcgcagcattttttcacggctgaattcttcccggacgccttcttttttcacgacgatcagaggcatctcttcaaacttctcaaatgtagtgaagcggtaatggcaggcttcgcattcccgccttctgcggattgatttcccttcgtccgcaggccgtgaatcaagtacgcgggaaccgttatgctggcatgaaggacatttcaaattggatcagctcccatctgtttcgttgctgtaatgcggttcgcaagcttccggtaaatgcccgccaacgtttctaggatgagcctatttgttgggagagccgatagaccggccttatcttttctattttacaaaaaaaatgcttaaagaaaaagcaatgctgtttttttacattagaaaaggagcatcagcttcaaagcgcgtaatggctttttcagcttagctcccttgtgtttgcgttttgaaaattacagtactttcgcttgtgcctgtttaatctgtacaggccccattcctctcggtatttcaatgttttctcttgtatctgcatgtaatgcgtccgcaatgtaatccgcagccacattaggatccaggtctccacaagtataaacatcaatgcttgcatatccgtgttcaggaaaactgtgaatcgttaaatgtgactcagagataataacgactccgcttacgccttgcggtgcaaatttgtgaaatgcgacctcgcgcacttcagctcctgatttcaaagcagcatttacaaacgttttttcaataaaatccatgtcattgagcttatcaaaatcgcatccccacagctcggagatgacgtgacgccccattgtttccataatcatggaccccccttaacaagaattaaaaaagtgaatttccgagaactgacccggccatttaccacgggggaaagttagtccggagaggtcctaaccctttaagtaattccgaagcagtcacgagcaagaagttcacgaaagatagtatactgtgtttaagtttattttgcaaggtgtgttttttgcgaatatgccgttaagggtttttttctaacaaatgtccatgatctttagtctacacagctgacgggtgtttcattcgcgcggcgacgtgacggataagatcaacgacccggcaggaatatccccattcattgtcataccaggcgagcacctttacttttcggtcttccatcaccatcgttgtcagtccgtcgatgatcgcagagtgtgaattcgtattataatccgaagaaacgagcggctcatccgaataatcaagaattccgtacatcgacgtttttgaggctctttggaaagcggcgttcacttgctcggccgacacatctgttttcagatcgcagacaaggtccactaatgacacattcggaacgggaacacgcaaagcgagaccgtgaagttttcctttcaaatgaggcagcacgagcgacagcgctttagcggcgcctgtagaagtcggaatgatggattctccgcacgctctcgccctccgcagatctttatgcggattgtcgatatttttttgatcattcgtgtaagcgtgaacagtcgtcatcagcccgctttcaatcccgaattcctgatcaagcactttgacgaccggcgcaagacagtttgtcgtgcaggatgcatttgaaataatgacatgttcatcgggattgaactgctcttcatttactcccatgacaatggtaacgtcttcatttttgcccggagccgttaaaatgacttttttcgcccctgcttcaatatggctcatcgctttttcttttgaattaaatttccccgttgcctctacgacgatgtctattccgcattctttccacggaagctctctcgggtcccggcgattgaacagcataatatgttttccgttgacgatcaggctgtcgtcggcggtctcaacttcttgatggtatttgccgtgaattgtgtcatactttatcaaatgagcaagcgtttccgggggatagcttgcattaatggctgttatttgaatttgatcatcttccattgcttttctgaacaccattcttccgattcttccaaacccgtttattgctacttttaccttcatgctcaggtcacccctttttaatatgccactctaatttacctttatttatatatagtataacacattaaaagaaatccgccagtacaacttgataaaaatccacccttataccgatcaatatgttgttcaatcggtttttttgcatataaaatgatttttcttccataaaaaaagcaggatcagcgtctcaggctgcctgcttttttcttatatttgtcccggttctttaaatttgtcattcaaaatgctgtcctctaaaacggaagacacctcgccgtaccgtttagcaatatgcatcgcgccccagtcacacagcgcatttaaaattctttccagactgtgcccgtattcactcagctcgtattccactttcggcggcacctgattgtacacgatccggttgatgacgccgtcagcttccagctcccgcaattgctgtgtcagcatcttctgggtgatgtccggcataagccgcttcaattcgcttgtccgttttttcccgcgcatgaggtggcagaggatcacacacttccattttccgccgatcacttcaagcgccgcctctacggatatattgtattttttcttcagcaacggtaattcctcctcatctataggaactaaaaagtgcctatggcacttaaaagtacgttcttttcaatgacacttctatcaatcataatgacatttgccggctgaaaaggaatgtactcttatacttatatcgtttacccggcatcatttcaaccatacattatcgtttaaggaggaaaacagatgtcttcacatcgccaaagctatttaccagcgctgctggcattagccgtcagcgcttttgcgatcggcacaaccgaatttatcagcgtcggactgctgccgcttatatctcaagatctgcatatacctgtgacaacggcgggacttaccgtttccatgtatgctctgggcgtgacattcggcgcgccggttttaacgtctctcacatccggcatgtcgcggaaaacactgctgctctgggtgatgttgatttttatcgccggaaatacactcgcagcgagcgcttcctcaatcggcgtcttactggcggcacgggtcatttcggctttttcccacggcattttcatgtcaatcggggcaacgatcgccgccaatatcgtgccggagcataaaagagcaagcgcgatttccattatgttcacggggctgacggtggctacggtgaccggcgttccgttcggcacctatctcggccagcaattcggatggagaatcgcatttgccgtgattgtggcggtaggaatcatcgcattcctcacaaacgcgcttctcgttccgtctcatttgcgcaaagggacgaaaaccgcattttccgagcaggtcaaactcgtcacaaacggccggttattgcttttatttattattacagcgttaggctacggcggaacgtttgtcgtgtttacgtatttatctccgcttcttcaggaggtaacgggttttcagaaagaaaccgtcgcggccatcctgctcatttacggaattgcgattgccatcggaaacatgattggcggccgtttatcaaaccggaatccgctgaaagccttgttttatatgttcattgtccaggcagctgtgctgtttgtcctgacttttaccgcgccgtttaaaacagccgggctgatcaccattattttcatggggctgttggcgtttatgaatgtgccggggcttcaggtatatgtcgtgatgctgagtgaacgttttgcgccaagcgccgttgatacagcatcagccttaaatatcgcggcatttaatgccggaatcgcgatcggctcgtttgccggcggaatcattacagactcaatcggaatcattcataccgcttggatcggggcgctgatggtgctcagcgcggtcgtattaaccggatggagcaggaagctggaaaagcgggatcgcactgcccttgaaaggaggtgagtttttcttcagcgcattttgatttttttcgacagacaaataataggaggaatatatacatgacaacacatttacaagcaaaagcaacattgcataacggagtagagatgccttggttcggcatcggagttttcaaagtagaggaaggcgcggaactcgtcaacgcggtgaaaacggcattggtgcacggctatcgcagcgttgataccgccgcgatttacggaaatgaagaaggtgtcggcgaagggatccgccaagggctgcaagaagcgggattaaaacgtgaagacatttttgtcacgtcaaaagtatggaatgccgatttaggatatgaagaaacgttaaaagcgtttgacacaagcttagaaaaactcggtttagattatttagatttatatttgatccattggcctgtcgaaggaaagtacatcgatgcgtggcgggcgctcgaaaccctctaccgggatggacgcattaaggcgatcggggtcagcaatttccaaattcaccacctgaaacatctcatgaaagaaacggaaatcaagccgatgatcaaccaggtggagtaccacccgcgcctgacacagaaagaactgcttgctttctgcactgaacaaggcattcagcttgaagcgtggtcgccattgatgcaagggcagctgcttgatcaccccgtattacaggagattgctgagaaatacggcaaatcagccgctcaagtgattttgcgctgggatttgcaaaacggtgtcatcaccattccgaaatcaactaaaaaacaccgtattgaagaaaatgcaaatgtctttgatttcgaactgtcagctgaagatatgaagcggattgatgatctgaacgaaaatctccgtgtcggtccggaccctgacaattttgatttttaaccagaaaaacaccgttcggctttccgaacggtgtttgtttatgcccagccgctcaatacttcctcaagctggtgctttgtatattcaagactgccgctgttatcaatgacggcgtcagctttttttgttttgtccgctaaaggcatttgcgacgttatccggctcatcgcttcttcttctgtcagggaattccgctccatcagccgtttgagctgaatgtctgccggtacggtgacgacgagcactttgccgacaagataatcaagcccgctttcatacaaaagcggtatatccaaaacgacgaactgctcttttctcgcaatggcttcatcccgctgtttcagcatttccgcacgcactgccggatgaacgatctgattcagcttcagacgcttctgttcgtcagtgaaaacgatagaaccgagtttttttctgtcaatatcgccattttccagcaggatgtcttttccgaatgcttccacaatttgtccgtaagccggcattcctttttccaccgcctgtttcgcgatgacatccgcatcaatgactgttatttttttgtcgatcagcatacgcgctaccgtgcttttgccgcttgcgatgcctcccgttaaaccgatgaccaagctcaaaaagcccactccttcttacattttccaaatcccgatgataatcagcaggactcccggcaaaaatgtcattttatctatccaattccaccttgaaagcaaatgccccgcgtttatgccgagtgaaacaaacagcgagctcatcaccccgacagtcacgctcatcataaccggagaaaagccgagaatggccgctcccagcccggcgccaaacgcgtcaatggataaggcgataccgagcagaagcgcctcgactccgttaatggttccggattgatcaatatcggcgctggtcggttttttcaaaatatgaatgacgatgccgagcgatttcacttcaagattaagcagcgttttttcatgcaataagtaatccggctctttagccggtttaaaaaattgccagatgacccatgcccctattccgattaagatcagcccgcccagtttctccgtgacggatacgggaaaaatctttgtcagaaaatggacgatcagcatggatataaacatcacagaggctgaacagcaggcgatcacggcaatcgctttgaacgggattttcatttttctcaaaccgtacgtaaacccgactgaaaaactgtccaagctgacagcaaaagccaaaagcagcaaagaaacaatctccatatccgtttctccctttctcttgatcggcaattgtgacatatgcctattgggtgaatcacaatatatatatggagaaaggtcatcaactgtgttagaaaaaagtcattctgctgccgcctgcttgaacagcttcagtttatgattttttttggcagcgggcgcaaaaatgagtgccccttccgccgaccacgattttagaaatcatcgtgccgcacgttttgcacggttcatcctttttgccgtatacgtaatgtttgagctgaaacattccgatctccccttgagaattgatataagaccggacggtgctcccgcccgcgtcaatcgcttcctgaagggtgtctttaatttctgtatgaagcgtttttatctgcccgtccgacagactgttcgcttttgtctcaggatgaatacgcgcccggaataaagcttcatcgacataaatattgccgaggccgacgaccgctttttggtcgagcagggcggtttttaccgcgcggttcgtttttgcaagccgctcttttaaataagcggcggtaaatgcttcatcatcgggttcgggcccgagctgtgaaagcggtaatgcattccgttcctctcccggcgcaaacaaatgcatcgtgccgaatttccggacatcccggtagcggagctgtgttccgtccgtcatgttaaacacgacgtgcacatgtttatcgtcaggctcatcggcctgatgaagaccgtatttcccctccatccgcaggtgggacaccatgacataatgatccaaatggaaaagcaaaaactttccccttcttccgatggatcggatcgtttctcctgcaatctgccgcgcgaattcctccggctcggcgggttttttgataatattcggccatctgatatccgccgattcaatcgttttccccttcacaagaccggtcagagtgcgccggaccgtttcaacttctggtaattccggcacaatcatcacttcctttttttctgtttattttgcatcgtaccaagacggccctgaagcataatccgccttcagcggcacgtctaatgccaaagcatgctccatcacttcaggaaccagcttctctaatatttcaatttcttccttaggcgcttcaaaaatcaattcatcgtgcacctgaagcaacagccgcgccttcaggtttttttctttcagctcagctgccatgtcaatcatggcttttttaataatatcggcggcgcttccctgaatcggcgtattcatggccgtccgttccgcaaagctccgcaggttgaagttgcggctggtcagctcagggatatagcggcggcgctgcataagtgtcgtcacatatcctttttgtttcgcttcctgcaccgattcttccatatacgccttgacgcccgggaagctctccaaatagcggtcaataaaagcgcccgcttctttccgggtgatgccgaggttttgcgacagcccgtaatcactgatgccgtaaacgatgccgaaattgacggcctttgcctggcggcgcatcgcttgtgtcacttcatcttcactgacatgaaacacgtccatggcggtttttgtgtgaatgtccatgtcattcgtaaacgcttcgatcagattttcatcttttgaaatatgcgcaagcacccttaattcaatttgtgaataatcggcggcgaaaataagccagtccggttcggacggtacgaaagcctgacggattttccgcccttcctccagccggatcggaatattttgcaggttcggatccgttgagctgaggcgtccggtttgagtcaatgcctgattgaatcgtgtatgcaccttatgagaacccttgcgcgtgactttcagcagcccttcaatataagtcgattggagtttgccgatttgtctgtattgcagaatgtacgcgacgatatcatgtttgtctgcgagcttctcaagcacatcagctgaagtggaatagcctgtttttgttttctttactggcggcaggccgagtttttcaaacagaatgacgccgagctgttttggtgaattgatgttaaacggctcaccggcgatgtcatggattttttcttcatattctttcagttttgccttgagctcttctcccattcgcttcagtctttccacatccactttgacgcccattgattccatttctccgagaattagcgcaagcgggagttcaagatcttcataaagctcaagctgattattttcttccaaagcgtcaagcagtttgtcacggaggctgttaacggcagacgctttccgcgcgagatgatcggcaagctctttttcagcgggaacggcgcgttttgcgccttttccgtatactgcttcatcttttgaaacgatattcagcccgtattctttcgctacgctcgcgacatcgtcgtacgaattgcccgggtttataatgtaggcagcaagaagcgcgtcaaattccgttcccttcagctcaattccctgccagcgcaaagcgacgacggaacgtttgctgtcgaacacccactttttcatcgattcatcttcagcccaagatttaaaagcttcagactgaatggcgatttctttcggaatataataaagacctgtttcattcacgatggaaaagccgaggatcggttcttcgtgatagttatcaccgatttgttcgacgaccaaagcggacggcgaaacaagcatatcttcggtgatttcttctgccgtttcgacattgatgtcttcaaaattttcttccgccgtttccccgctttcttcaccgagccgctcaagaagcgtattaaaaccgaggtctttaaaaatggcaacaacttgttcacggtcaaacccttggtaatctaaatcttcgggcttgacttcaatcggcgcatttgtcataatcgtcgccagctctttgctcatcagggcttgttccttatattcttcaagcttttcttttaatttttttccgctgacttcatcaatggaatcaagcagtttctcaaccgaatggaactgctttaagagcttaatcgcggttttttctccgacgccggggacgcccggtatgttatcggatgaatctcccattaatcccttcatatcaatgatttgcaaaggagtcagaccgtacttttcccgcacgtgctccggcgtgtaatcttctacgtcggtaatgccttttctcgtaatggcaacggtcgttttcccggttgcaagctgggttaagtccttgtcccccgaaacgaccttcacttcgaagccgtctttttcagcagatacggcaagcgtgccgataatatcgtccgcttcatattcaggaagctcgtagcggctgatgttgtaggcatcgaggagctcacggatgaacggcatctgttctgaaagctccggcggcgttttttgtcttccgcctttatattctttaaacgtgctgtggcggaaagtggttttccccgcatcaaaagccaccagcatatgggtcggtttttcatcctccagcattttcattaaaatcatcgcaaacccgtatacggcatttgtatgaatgcctttttcattgcttaaaagcggcaatgcaaaaaacgcccggtacgccagactgtttccgtcgacaagcactaatttttttcgttccgtcattcaatatcctcctaagagcaaaagctcgtcattcctctgttttttaatctcacagcttctcttattttaacaaagttcaatttgaaaggaaaatgagcggaccccgtgaaaacgcaaaaaaggacgggaacaagaaaacgcgttcccgccgtcaaaattggctccttggatgaaggggttctgttatatcctaacaagataggtttaacaggtcatgaagaaattgttaatcctttgtaaagctgatcacgctgccggcggccgcttcagcgtcacagtgaacacagttccctgtccaggctcgcttgtgacctcgattttaccttcatgggcttctattaagtgcttcacgatggcgaggccgaggccggttcctcccgagttgcggcttctgtctttatccacgcggtagaatctctcaaatatccgcgggatctcttctttctgaatgccgattcccgtatcggacactttgatatcgacaacggtttctttcacatgtaccgaaatccccaccgtccctttttcaggcgtgtaggtcagggcattgttcgccagattcaaaaatacctgcttcagcctgtgcgcatcacccgtcacaaaaatcggctcttccgggagatcgagctgaaagctgatgcctttttcctcagccttatgctgcaaaagcgcctcaatttcatgcagaatttttgcagcatcaaaggactctacgcgcatcgtaaagttttgctgctccatcttggataaatccaataaatcctgcacgagagattggagccgctcactttctttcagaatgatagacagaaagtctgaaagcgccttttcgtctttcatcgctccgtctaacagtgtttccgtaaatcctttaatcgaggtgatcggtgttttcagttcatgggagacattggcgacgaagtcctttctcatctgctccaattttttaatttccgtcatatcgtgaaaaacgaggacgatgcccttccattcatcatcagggcccatgatcggaacgccgtcaacttcaaagtagcgccgctcaatgttgatgggaagtctgagcagctggcattttttcgtctccgtcataaaaatgtcttcgacaagccgaatgatctcctcatgttcaaacgcatcgtggtaaaggcgccgaagcagacgttcaggctttgtatgaaactgcttcgtgtatgaccggttcacgagattgataaaacctctcccgtctattaaaatcaaaccggatccgatattttcaatgacggttaacagacgatcgcgctgcatatcctgcgttcttgtcatttccattaaatcgaccgccaggctgttcatcgcacgcccgagacggtccgaccgccttgcgtaaccgctgtaggagcgggcgtcgtaattccctttggacagctccgtcgccacctttgtcgcggcgtcgattgattttttgtaacgcgacgtcatgtttgtataaaagaaaacgataatgataaaagcggtacaaagacttgctgccagcatgccccacatttctccggtaacgcttgaaccgccgttgatatccgaggaaacgagtacataccccgcaattttcccggcgtcattttttacggcagtgccgcggatgactctgcttttcgactgtacggcttcctcgcttttattgtgagaaatgaactcctttacggctgaatcatcaccacgactgccggaatgatatacggcgtcacccttctcgttgagcaaggagacgtttataccgagggtgcggccggcgtcacggattaccgtttcattgcttttattgccgattcggccggtgtcaagaaggcccgctatgtataccgattcctttttcagctgatccgccgttctttcttcagcggatgaagaaataagctgctgtaaaaaaaggccgagaacactgaaaaccaatatgatacatacaacgagtaaagcgaacagacgcacacggactttattcattcatttttggctcctccagtttataccccaaacctctgattgttttaatatagatgggttttttggtatttgattcgattttgtcgcgcagatggctgatatgaacgtcaacaatccgggtatccccggcaaaatcatagttccagaccgcgctcagcagaagatctctcgtcagcactcttcccttgtgttttcccaaatacagaagcagttcaaattctttaggcgtcaattccagctgttctgacttgaagtacgcttcgtaatgctccggaagaattttcagctcgccgatgaggatctgcccgtccttttcctcttctctgccttgtgacagcgaagaaatgtcagcccttcttaaaatggctttcacccgcgcagtgacttcccgcggactgaacggctttgtcatgtaatcatccgctccgagctccagtcccagcaccttatcaaattcctcatcttttgctgtcagcatcaagatcggaaccatcattttctgctgtctgagctgtttacagacgtcgattccgtccactttcggcagcatgacatccagtacgattaaatccggattttcattctctgccagctccagagcctcttcgccgtctgatgcggttatgacatcatagccggaccgttccagattatactgtaaaagagtaacgatagattgttcatcatctacaactaaaatttttttgttcatgctgcgccctccgctgtctattttccccgacatccaattttctctattttatgtgctgcatatcactttatgatttcattttatccaatactgcccgttcagacaattcgcctttttgatcattttcagagaaaggatcgctcagggaaaaagaaaacgctttcattaattgtaaaaagaggaaggcttctgattcggaagccttcccttttttcttatgacaatactttcatcacgtttttgacagattcaactgatttactcagctgcgctttttcatagtctgtcagttcaagctcgatgatttgctccaggccgtttcctccgataatcgtcggtacgcctaagtaaatgccttcatgaccgtattcgccttctaagtaagcgatggtcggaagcacgcggcgctgatctttcaaaatggcttctaccatttcagtcagtgatgcagcaggcgcgtagtaggcgcttccgtttccgagaaggttgacgatttccccgccgccttttcttgtgcgttctacaatcgcatcaagacgttctttcgggataagcgtttcaagcggaatgccgcccgcataggaataacggacgagaggaaccatgtcgtcaccgtgtccgccaagaacaaaaccggtcacatcttttacagacaggtttaattcttcagcgacgaatgttctgaatcgcgcagtgtcaagcactccggattgtccgatgacgcgttctttcgggaagcctgactctttgtacaccgcatatgtcatcgcatcaacagggtttgtcaatacaacgataatgcagtcaggagaatatttcacgatctcacgtgtgacgcttctcatgattttttcgtttgtagatacgagatcatcacggctcatgcctggttttctcgcaattccggctgtgatgacgacgatatcagaaccggctgtgtcctcgtagttggacgtgcctgtgattttcgcgtcaaatccttgaaccggacttgcttcgagcatgtctagcgcttttccttttgtcgggttttctaattgcggaatatcaacgagcacaacgtccgcaagctctttttgagctgtaagaaaggctgttgtcgctcccgtaaatcctgctccgataacagaaactttactgcgtgtttttcccatgattctcttctccttttttggcttcattagaagtctgctttaggttcagtccatgtttttgatgagctcttcaccgaactctgaacatttcacttcagttgcaccgtccattaatctagcaaaatcgtacgttactacttttgaagcaatcgttttttccatagatttaatgatcaagtcagcagcctcattccagttcaggtgttcaagaagaagcactcctgaaagaatgacggatgacgggttgaccttgtcaaggccggcatatttaggagccgttccgtgagtcgcttcgaaaatcgcatgccctgtttcatagttgatgttcgctcccggcgcgattccgattccgcctacctgagcggcaagcgcatcagagatatagtctccgtttaagttcattgtcgccacgacgtcgaattcgctcggacgggtcaagatctgctgaaggaaaatatcagcgatgctgtctttgacgatgatttttcctgccgcttccgcttcgctctgcgctttatcagccgcttcttttccgtctttttcgacaatgcggtcatattcagcccaagtgaatactttatctccgtattctctttcggcaagctcgtagccccagtttttaaatgccccttcagtgaacttcataatatttcctttgtggacaagcgtgacagacttacggccgttttcgatcgcatactcaatggcagctctgactaagcggcttgtgccttcttcagaaacaggcttgatcccgattcctgacgtttcagggaaacggattttgttaacgcccatttcattttgcaggaagctgatcagcttttcaacttcttcagaacctttcgcatactcaattccggcgtaaatatcttccgtattctcgcggaaaatgaccatatccgtatcttcaggacgtttgaccggagaaggcactcccgtgaaatatctgacagggcgcaggcacgtaaacaaatcaagctcctgtctcagcgccacgttcagagaacggataccgccgccgaccggcgtcgtcagaggacctttgatggcgatgaagtactctctgatgtcttccagtgtttcggcaggaagccactcacctgttttattataagccttttcaccggcataaacttctttccacgtgatttttttctcgcctttatatgctttttcaacagcggcttccaatactttagaagcggcattccaaatatcagggcctgtgccgtcgccttcaataaacgggataatcggattatttggtacgtttaatactccattagagactgtaattttttcaccttgtgacacaatattacctcccagtatgtaattcatatttagaaaacattttatttttcttgtataaaaaataaaatgacttttctcaagattctatcaaaattgtaaaccaatccgggcttgattaacaagaggctaacgacatgaaaatcaccagcctcccgtttgatcaggctctttcatcaagcggaacaaaagtctgcttatccggacccgtgtaatcagcgcgcgggcggatgaggcggttgttatcgtattgttcaagaatatgggcgatccatcctgacattctgctgaccgcaaagatcggcgtgaacagatcgtgatcaatgccgagactgtggtatacagatgcggaatagaaatcaacgttaggcggaagttttttctccgacgtcacgatttcttcgacacggattgacatctcgtaccatttgctttcacccgtcagattggtcaggcgtttgctcatttcttttaagtgtttggcgcgcgggtctccatgcttatacacacggtgtccgaagcccattactttttcctttttctccattttgctgcggatataaggctcggcgttttccacttcgccgatttctgtcagcattttcatgacggcttcattggctccgccgtgaagcggtccttttaaagcgccgattgcggcagtgatgcctgagtaaatatcagataaggtggcgacacatactctcgccgtaaatgttgatgcattcagctcatgatccgcatgaagaatgagcgctttgttaaacgcttccacttcgatcggagaaggctcttcaccgtttaaggtgtaaaggaagttctccgcgattccgtactcttccttcggttcaacaggatcaagtcctttgcggattcttgagaaagcggcgacaatgcccggcactttcgcctgcagacggatggcttttctgtagttcgcttccggattcatgacatcggcttcactgtcagtcagaccgagtaatgaaatcgccgtccggagcgcagccattggatgtacgttattgaggggataggatttgaagtgctcaatgatttcttgtggaacggcagcttctttcgcaagctgttttttcagttcagcaagttccgttttattcggcaggcgcagatgccacagcaaataaatgatttcttcaaaacttgcattctctgtcaagtcgtcaatatcgtaccctacatatgtaagggtatcgtcgataatagagcttacagatgatgttgttgctacaaccccttcaagaccgcgtgttgctgtcatattcaacctctccttttcaatcaaaattcccctttaaagagtatataaaacatacggcttacttaaaatgagtcatgcaaacaatccctttcccctttaagaaaatgcttacatttcactggttgcggttacataaccggtatgcttatagaggaacataacaaattcttataagcttatttaagtttaagcctattcttattataaacaataatctgattaatttgtagacttttaactaaaaatgttttaaaagccctatatatcaaggcttggcgttgataaatttaatcgcttgctttcagatgctttgtaaaaccatgtattctcatgttttcatttggggggagctttggggaaactttaaaaggacaggcgcaacaacttcaccgcaaatccctccttctttaccggagaaggggggattttgtttactcgactgaatcaatgttcggatcagcttcggaaatccatgtcttggttttagttggctccccgtacatggactggaaccgtttgactgcatttgcgctgttgtcggcccgtaaatatcctcatcaaaccgttcatcaattgaaactgactcatttactgatgtaggtgaagttaaataaatgcagaaaaaccctcctcatctcgagaagggctcgatttctgcttcttttttctaaatcagtccgaagaaaaaactgatgccgctcaactttttaatcgaagggcttcgggttctccaactatttgcccctatgcttttcttttgctttttgttttctgattaaatatttttgttcctttattttttctctttgttttctgttcagttgttttttcttttcttttcttgcttcaagctcctgttttatcgctttttgcgccttagttgatatcctgatatttttcatctctttagaagcttgccgttgtaatctttttgggtttaacttcttagattttgctttaacacaaacccctgtttgttcagtgcgggagagagtctgtaaaagttgattatgaacaaaatgcatgatttctgaatccttgggctcttttccaaacaaatgacgaactgctcttaatttcccatcattcacaacttcaatgactcctacccaaaactgaccatcgtagtaaaccgttaatttcataacgattccctcctcctaaatttactgaagaatgatggacatcccgaggaggggaaggttactgacattttaaataatgcatccggactaccaaccgaattgtgttttttcattctcattataaatttaacaaactttcaaattgaaggaaagggtctccgcttattttaacaacacttcaagttttgatttggttcaagtgcataaattccatcagcttttaatccattcatcaattggaaccgccttactgcatccgctgtcatcgcacaatatgcgccggcgattccgaagttctttgttacatggtaagccacttcattcctcggaataatgcaaatggcatttgtctgaactacaaaatgccctgcaaactcttattttcacccgcaaaaaaaagcagctttacgccgcttttttactttatgaagtgaatattttaacgatttgcatggccaagtaggcgattccggcgccgattaacgggccgacggcgacgcctccgaaaagcgcgacggcaagtatcgtgccgatgaccagcgccgttgtaatatgagggtcgttttccaataaagtgagaccgtttttggcgattaaggcaaccgcgatcccggcaccgagagcgatccacgcataatatgatttcatcgcttctccgagctgtttaaaaccgatatcacctgtggcaatcggcactaaaacggcgattgtaatgacggtgaccccccagttgatgccttttgactgaataaccggaaatagtttctgatcaagaccgacagcttttatcacaatgagaaagccgacggcaaaaagcaatgactgatttttggctaccaatgcgatggccagcaataatagtaaaaataaattcgcctgtgtaaacatcctgaaagcaccctctttcatcatatctgtaatcatatccttttttttgacgaataaactaatgtaataggacgtgccgaccgagaggaggatcgatgtgaatccgcactatgcaactgtttttttccgcgcgctgtttgtactcgctgcggccggcggcgctttagcggccggttacgcctcatttccgttaacttatccgtttctgatcgcccttattctgtcatcagcgatcattcccgttgttgactggctggacaaactgacggggctgccccggtcagtcaatacagtcattgtcctggtcttctttttgcttattcttctcggcgcggcaacatttctcgttgcggaaatcatttcgggaaccgcctatctggccaaaacgctccctccccatatcagcgcctttatgacgtattgcgaagagctgttcacttcccgcattcagccattgtaccacgagctgaccgtcctatttaacgggctggaaaccaatcagcaggcctccatcgtgacgcatattcagaccctcggtgatacagccgctaaaaatgcggggctcatgctttcacatcttttggagctggtgccgaaatggattgccttccttcccaatacagctgccgtcttcattttcgcaatgctggcgactttttttatgacaaaggactggcataagctgaaggcgctgctttattccatttttccggaacgggtttcggcaaacgccaaggccgtatcgggagagctgaaaaaagcgatggcaggtttcattaaggcgcaggccgtgctcatacttttcacgatgatcattgtctttatcggactttttcttttagggattgagcatgcggcaaccatcgccttttttatcggcctggttgatctgctcccgtatctcggcgccgggtcggtctttgttccctggattatgtatttggccattgccggtcagcttcctcaagcgatcggtctcggtgttttatatattgtggttctcattcagcgccagctgacggagccgaaaattttaagcaagtcaatcggacttgatccgcttgcgaccttaatcgccctgtttgccggctttaaattgttcggaattttaggactggctgccgggcccgcgctgctcgttttcattcaggcctttatcacaacgggcgctctaaaagaaatatgggcctatattactgttcaatccaaataaaaacagcagccctgtaagaaggctgccgttttttatttgataatgatccgcttgttttttgacatccctctcagccatttgaacaaaagcggcttcatgcggttccgagtgaacggaatcagaagacaggcccctgcaatatcggacagaaaacccggaagcatcaaaagcaggcctccgaaaaagacgcatattccgtcaagaagcgcttcccccggcattttgccgtgctgcaggtcgcgcatcacccgatgatacacatcggttccctgtctttttgccaccaaagcgcctaacacgcctgtcaaaatgatgagaaggaaggtcggaaaaataccgagccattttcccgccagcagaaacaaaccgatttcaattgccggacatacgataaacagtaagaataacactctcatttttctgccctcctgcccttctaaaagcgcgtcaccgcccgcatgggaataggaaaatcaacctaaagacaaaagagaagggagaacccccctctcttttttaaagctgtttaaagaacgcttgcgcggccttcatacacagcgccgcgggcagcgtcaactgtgataacctgtccttctgttaaaactgaagttgcgttctcaaggccgacgataaccggaatgcccaagcttaaaccgacaacggctgcatggcttgtcagaccgccttcttcagtgatgagcgctgatgctttttcaagtgaagcgatcatgtcgcggtcagtgcttgaagcaaccaatactgcgccgtctgtcattttttgttcagcttctttcgcattttttgcaacaacgaccggaccgaatgcagatttgcgtccgatgccttgccctttcgcgataatgctgccgacagtgtggactttcatcagattcgtcgtgcctgattcaccgacagaacctgctgtaatgacaatcagatcaccgcgtttcacgatgccgctgtcaagtgatttttgaaccgcgtcttcaagcatttcatctgtagaattcgcgttttggccgcttgacgggaatacaccgaatacaaggccgagtttgcgtgatacagactcattaaccgtaacggctacaatcggagcctgcggacggtatttcgcgatcatacgcgccgtatggccgctttctgtaggcgtcacgatagctgccgcactcagattgatcgccgtgtgcgcaactgattggccgatcgcatcggtaatcgtcatgccgacctgatctctgcgtttagacagaatttctttatagttcagagattcttccgtgcgtgtggcgatgttaaacattgtttgaaccgcctcaacaggatattgtcccgcagccgtctcaccggaaagcatgatcgcatctgtgccatcgaaaatggcgttggcaacgtcacttgcttcagcacgtgtcggacgagggttgcgctgcatgctgtctagcatttgtgtcgcagtaataaccggtttgcccagcgcgttgcattttttgatcatttctttttgcacgagcggcacttcttcggccggaatctctacgccgaggtctccgcgcgctaccattaggccgtcagatacttccaggatcgcatccaggttgtccacgccttcctggttctcgatcttaggaatgatttgaatgtcagacgcgttatgctcttcaagcagttcgcggatttccaggacatccgtagaacggcgtacaaatgacgcagcgatgaaatcaacgccttgctcgataccgaatatgatgtctttggcgtctttttcagtaattccgggaaggttgacgctgacgccgggaacgtttacgccttttttatttttcagcgtgccgctgtttaagatttttgttttgatttcgtgtttttccggatttgattccagcacttccaatccgattaaaccgtcatccagcaggatgatagaccctgctgacacgtcgtctgccaggccttcataagaaactgagaatttttcaagcgttcccagcacctgtttcgtagaaacgataatttcatttcccgcctgaagctcaagcgcgccgttttccatatcgtgcgtgcggatttccggacctttcgtatcgaggagaatccccacgtttttgccgagctttttgctggcttctctgatgtttttgattcttgcgccgtgctcttcgaaatcaccgtgtgaaaaattcagacgagcaacgttcatacccgcttccatcaattttgtcagcatttctacactttcactggccggaccgattgtacaaacgatttttgtttttttcaactcgttcacttccttctgaaatcttcagcttcttccgccttaaatagacagttcttttgaaagctgatacatgtttggttcaacagtatgttttgattctaaaatttctataatatcatggtctacaagcttgttgttttgtatacctacgcagcgtccgccttttcctttaagcagaagctcaaccgcgtaagcgccgaggcggcttgcaagaacccggtcagaagcgcttggagatccgccgcgctggatgtgccctaaaacggatacccgtgtttcaaggttcgtttcttcttcgatgcgttttccgaattcaaccccgctgcctaccccttctgcaacgatgatgatactgtgttttttgccgcggtcgtgccctctcttcaaacggccgataatttcctccatatcgtagtccgcttcaggaattaaaattgattccgctccgcctgcaagacctgcccataaagcaatgtcgcccgcatggcgccccatcacttcaataacgtatgtacgctcatgagacgtagcggtgtcacggattttatcaatcgcatcaattacggtgtttaacgccgtatcaaatccgatcgtaaaatcagttcccgggatgtcattatctatcgtacccggtacacctacacacggaaacccgtgttccgttaattttttcgcacccatgtatgaaccgtctccgccgatgacgacaagaccttcaatgccgagtttctttaaattttcgattcctttttcacggccttcaactgttttgaattcaggacatctggccgtatacagctttgttccgccacggtggatgatgtcaccgaccgaacccagctccagtttttctatttttccgctgattaatcctgaataaccgttataaattccgtacacttcgacgtcgtggtagatagctttccgcacaaccgcgcgcaccgcagcgttcatacccggggaatccccgccgctcgttaaaactcctatacgcttcatttcctattcacctcagcaactatatatgttaaacatatcatgatcattgccctaaaacaatgaaaagggacgcctgagctcccatgaaaccttacctattatacaattaaataaattgtttttaaataaaatttaaggaatatcacaaaaatcacaaaaaataaacgtgagccataggcttcacgtctattcagtttaccccgatatattgatcctcaaccgaaactttcccgattgctttatatttttcatagcgctgtgagatcaactcttcggcgttcaatcgaagaagagattttaacgtttctttaagaataccgtcaatgtagcccgcctgctgcttgatatcatggtgagctccgcccttcacttctttaatcatatcatcaataattcctaattctaataaatcgggcgcagtaatcttcatggtttcggccgcttttttcgcaaggctggagtctttccacaaaatggacgcggctccttcaggagaaataacggaatacgtcgagttctcaagcatcagcatgcggttgcccacacctaacgcaagcgcgcctccgctgccgccttccccgatgacgatacaaacgacaggcactgtcaggccggccatctcgaacaggttcttggcgatggcttcactttgtccccgttcctccgccgctttacccgggtacgctcctttcgtgtcgatgaagcagataatcgggcggttgaacttatccgcctgcttcatgagacgaagcgctttgcggtagccctcagggtgaggcatcccgaaattgcggacaaggttttctttcgtgtcttttccgcgctgatgtccgatgacggtgaccggcatgccgtgatatttggcgactccgccgacaatcgcagcatcatctccgtatgttctatctccgtggcactcaaaaaagtcggtaaacagatattgaatgtaatcaagcgtcgtcggccggtcgggaaggcgtgcgatctgcactctgtcccacggcttcaggtttttataaatctcatcctggagcttgctgagccggtcttcaagccttgcgatttcagcgcttaaatccatctccgaatcttgggtgaattttttcagttcggcaattttcgtctgcagttcaatcaccggtttttcaaattctaatcttgcagccactcatgctcacctcctgtttggtgcatgtccagcagaaatgcgagtttctctttcatgtcgtttcggtgaatcaccgcatcaagctggccgtgctttaataaaaattccgccgtctggaaatcttccggcagtttttccccgatcgtctgttcaataatacgtcttcctgcaaatccgatcaaggcgcccggttcagcgaaattataatcaccgagagacgcgaaactggccgatacgccgcctgtcgtcgggtgggtcatgacagaaataatcagtccctgctcctcactgaacagttttaatgcagagcttgtctttgccatttgcataagacttaagaccccttcctgcatacgtgcgccgccggaagcggtaaagatgataaacgggactttttcctcttttgctttttcaattgcaagcgtgattttttcgccgacaaccgaacccatgctgcccattcggaatgttgaatccatgatcgcgatcacggcagggaatccgctgatggttccttttccggtaaccaccgcttcattcagcgatgttttctcacggtctttttcgattttttctaagtattccgggaaaccgagcgggttttcagatatcattccctggttgaattcttcgaatgaatcttcatccaggaggctttcaatgcgctgctttgcattcatcgggaaatggtgcccgcagttcatgcagacgcgcaggtttttatctaactcttttgtgagcatgatttttttacatttggggcactttgtcataatgccttccggaacatcatgttttgcctgctcagacggcacggaagcatattttttcttttttgtgaatatatcctttaacaaatgattacctcccttttgtgaagggttctcttcactgcatgtcttccgattagatagacttaataataactttaccgaaactattgtactttttttgtcaaacggtgtcatcctccattcgacattttttgctgcaaaacagacggaaacggacggatttcataccgtaaaaagcgttgttcagccttatctgtcagcgttttcaaaagaaataaggattctgctgaaatttttttaagacctgcccttaaaaaaatgccagcagtccgtatattgaacagcagcgcgttgttttttccaacgcgctgccatttcatttttgtgttattattcgccgatgactgtgagctgtcttgttttttcagccacttcttcaggatcgaccgtaattctggcgacgcccgtttccatcgctgctttcgcaacagctttcgcaacggcaggagccacgcgtttgtcaaacggagccgggatgacataatcagcgcttaattcttcctctgaaacaagggaagcaatcgcttcaaccgcagcaattttcatttcttcgttgatgtgagtcgcgcgaacgtcaagcgccccgcggaaaattccagggaatgccagcacgttgttaacctggttcgggaaatcagaacggcctgttccgattacgctagcgccggctgcgcgcgcgtcttcaggcatgatttccggattcgggttggccattgcgaagataatcggatctttcgccatgctctccaccatttctttcgtcagcgcgccttcgactgatacgccgataaagacgtctgcatctttaatgacatcctgcagcgaaccgtcgttgcggtcttggtttgtaaacttggccacttcgtttttcaccgcgttcatgccggccggacgcccttcgtaaatcgctcctttagagtcgcacatcacgatgtcgcgtacgccgaaatggtaaagaagcttaatgatcgcgatgcctgccgctcccgctccgtttgccacaactttaatggatgacatggattttcctgataatttcagggcgtttacaagtccggcaacggttacgatggcagtgccgtgctgatcatcgtggaaaaccggaatgtttgtttcttttttcaggcgctcttcgataatgaagcagttcggcgccgcaatatcttcaaggttgacacctccgaatgtcggttcaagcagcttcacagtgtcaatgattttgtccacatcgtttgtgtcaagcgcgatcgggaatgcatccacgcccgcgaaacttttaaacagcaccgctttcccttccatgaccggaagtgaagcttcaggcccgatattaccgagaccgagaacggctgatccgtctgttacgactgctaccatgttccccttcattgtataatcatatactttatttttatcgtcataaatctctttacaaggctcagctactccgggagagtaggcaaggcttaagtcgtccgcgtttctgacttctacctttgcttttgattccagctttccttgatttactttgtgtaaatgtaacgcttcttctcttaatgacattctaaacactcctttaagtactttgttacatattctgccgcatagactggtacaatcgctggaggtgaaaaatttcagaatctttaaataagatagcacaattgtttcaattgtataacaaaacgattattgttaccactattttaacacgacgttttcgcggcccagcagctcttttaaacggtataacgcctgatggtccgcctgaatatgaaaagtatccggcagcctgatcgtctgcttgtctttttcataatatagataaacgccggtttcccctttatgctccagtaaaatacgcttcatcttttccaaaaactcctgattgtgccggctgccttcgattttgatgtaaacagacggcgctctgtctgcctccgtctgttcaagaagagaggcggatgacatgatgaattgtgtcttctcctgacgctcttccatttttccggcggcgaataaaagcgcgccttcttttaacagcggagacagccttctatattggtcaggaaacacgacggcttccatttctcccgtttcatcgcttaatgtgagaaacgccatatgctgacctgtctttgtccgaatcgttttaatgcccgcgagcaaagcgccgattgacagctgtcccttcggcatctgccgcgctgctgtgatcgtttgcgccccccgttttttcaggagatccctgaaagcagacaaaggatggcttgagaaataaacaccgagagcttctttttcgaaccgaagcttgtccacgagcggaaattcctcagcctctacatattttggcttaatggaaaacgattcttccaaaaacaatcccatttggtcatcgtctgcacgaaaaagttcagcgtgctctaaagccacatcaacggaggccagcaaggcggcgcgattttgattgaattcgtccatggcgccagaaaatataagggcttcgatggttttccgattcacgctttttgcaggtacgcgaaagcagaaatcgaaaagatcctcgaacggtttatgtgttcttgctttataaatatctttcactgccgagacgcctacgtttttaacggcccgcaaactgtatctgacggctccgttttccggcgcaaacggaaaaccgcttttgtttattgacggcggaaggacttgaatcccgctccccttcgcttcatgcagatattgcgatattttgtcctcattgccgatgacgctcgtcaacagcccgcacataaaatatagcggataatgcgcctttaaataggcgagctgatagccgatcatgctgtatgcgacagcatggcttctgttgaatccgtagttagcgaattttacaatcagatcgtagacctcgtttgcagtgactacagaatactccttttttaagcacccttcaacaaaatggcttcgctctctgtccagaatgtccttttgctttttgctgacagcccgtctgagcagatccgcttcacctaatgaaaaccctgccatgcgcgaggcgatcatcattatctgttcttgatagacgatgacgccgtaagtgtcactgagaatatttcttacgtcctcgtgcggcacttccacacgcgcccgtccgtgcttccgatcgataaataacggaatattttccatcggtcccggcctgtaaagcgcgttaaccgcgacaatgtcttccagtcttgacggcttcaggcgcttcagcacgtttctcatccctgatgattccagctggaaaatacccgtcgtatcaccgtttgacaatagcgagaacgttttttcatcctgataagaaatctcggaaaaatcaattttcgtattcgtctctttttcaatcatcgttttaatggattcaataagcgtcaggttgcgcaaacctaaaaagtccattttcaaaagaccgagatcttccaggtgatccatcgcatactgcgttaaatacacgccgtcatgcccttcttgaagagggacaacttccgaaagcggctctttactgagaacgaccccggccgcgtgtgttgacgtgtgtctcggaagaccttcgattttccttgcgatctgaaacactttatgaagaacggcggattcggacagccgcctgttcagctgagcggactgccgccttgcctcctcaagcgtcattcccggtttcgacgggatcaggcgggcaagctggtcggcttctttcgggctgattccgaacactctcccggtatcccttaacgccgcctttgcggccaatgtcccgaaggtgataatctgggcgacgtgcatggccccgtacttattttgcacatactgaatgacctcatcccttctcgtatcagggaaatcgatatcaatatccggcatgctgatccgctcgggattaagaaatctctcaaacagcagagaatgtttaagcggatccacgtcggtaatgaaaagcgagtaagcgacaagcgagcctgccgcggacccccttcccgggcctgtcacaatgcccttttcatgcgcgtacttcataaagtcccatacgatgagaaaataatcactgaatttcatgcgcctgatgacgtccagctcatattcaagccggcggacagcccgctcatcaggagtgccgaaacggagacgcagcccctcatgacagatctccgccaaatagtcatcggctgatttgccgtccggcgccggaaaagacggaagctgtgtctgtccgaggctgacatcgacccggcattgccgggcgatacgggcggctgcttcaaccgcttccggatgccgcgtgtaaagctctgccatttcttcaggcgtcctcaagtataagtccggcagattcccgctctgatcctcccatttctctccggctttaatagcgcacagacagcggtacgcatcttgatcttctttcttgatatagcggacatctcccgcagcgcagacagcgatttccgtctcggctgacaggcggagaatctcttctgataacgtctcatgtcctttaaacggctggtaccctaaataaaaacggccgtctccgaacagctcccggaatccttcggcagcccggaccgcttcttcaaacttcccggcttgaagcaggctttcaatgtacccgttttcaccgggcgtaatggcgatcagcccctcatgatagctcttcatccattttcgcttcatgccgccctttgccatggattgcagcgcacttgagattttcaccaggttctgataaccggtgtttgtctccgctaaaagaatgagcgggtgtgcttcaagctccgtatcgtccgtgtatatagaagccgtcagaccgataatcggcttaattccgtttgatttgcatgctttataaaactcaatggcgccgtacatcacattttcgtccgtcagcgccaatgatgaatatccgagttccttcgcttgtgtaacaagctcttttacagaagcggcgctgtttaacaggctgtagccgctatgtacttgcaggtgaacaaaagacaatgccgccactcctttcccatacgttcattttgcctttctacattataagacgggttttcttaagaaacaaatgttcttttttgactcatcatcatacttgtccgtttcgctcaatatgatagaaaagtgaggtggtgtatatatggatcaggaagccggctttatggcgaatttcatcagcagttattttatcgccctcggtgtgttgctcggcggcgcgctgatcggcggcctcggagcttatttatcaggcgagcctccgctgacggcgatcacaaaattggcgaacaggctgaagatctgggcgcttgtcgcggccatcgggggaacatttgacgcggtatacagtttcgagcgggggctgtttgaaggcaacacgcgcgacatcttcaaacagcttcttttaattatttcagcaatgggcggcgcgcagaccggctggctgattatttcatggctgacccaggagaatatgtcatcatgagaattcccgagtattataaaaaaccgggatggcagcgtttttttgcgggaatgatgtgcggagccatcatcagctggctgttctttctgtttacatacggaacgtttcaggaagaacaggtgacgttaattgaaaagcagcgggagcacgcgcgggatttaaaaaaccaaatctccatctatcagaaagatcttcataaattaaatgaggataataagcaaagacttctcatccaaagtgttgatgtgaagctgattaattgggaaaaatacagaatcgcccagcctgacaagatgaaatttgaggaacaggtgaaagataatatttctgaagtcatcacaaaggatattgaaagcgtgtataaaacaaaggagcttttaaaacggacgattgaaaacaaaatatacaccataaatgagaaggaatttaaagctgaagtaaaggaactgacgatttatacgagattgtctgtcgaaattcatatttcttttgcgacgtaattatgtcatttttaaaaattttccatagatctgtcgcttttttctccgcttttttataaactgtagatgagacattttcaacgattctgaagggaggaagggaaaatggaggtttttagtgaacgccgcttggcaaaagatcatgcagcccgaatcagacaaggctattccgcatatgcagaaacagacacactcgcttccctcataaaaaaagaactccaaatctgtaatctccgcgtctacgaagacctgactgaattcggctgctggttcatccccgtgacagatgaacactaagaaagagggtctcccctctacttgtgttcgttacatacctcttccagatcagcaagaatctgatcggtttcatcccagctgaagatggatgcgccggccgcaagcggatgtccgccgccattgtatttccgggcaattccgttgatgaccggaccttttgaacggaaccggactctgatttgatcgtcttcttctacgaaaaacacccaagcgcggatacccgaaatatttccgagtgttccgacaagctgcgacgcttcagaagcggtggttccatatgtctccaaaatgtcttttttaatgaaaacggaagcgacgccgttttcagacagtgacacattttgataaataaagccgttaagcttcaccacatttaattttgtttcatacaattgattgaacagctctgacgatgaaaatgggaactcaatgagctctcccgcgtattttaatgtcttttttgtggtgttcgggaataagaagcgccccgtatcaccgacgataccagcgtagatcagctcagctgctttcgtattcagtttccagccgtgctgctttccttccaggtacagctcatagatcatttcgcttacggagcttgcattcgtatcgacccataacagatcgccatacggatcttcatttggatggtggtctattttcatgagctttgcgccggaatggtagcgctgatcgtcgaccctgccttggtttgcggtgtcgcacacgatgacaagagcatctttataggtttcgtcatccacctcatcgagggaatataaaaaagacaaggacggttcaggctgtccgacggcaaaaatatttttttcgggatacgtttcccgcaggatttccgtaaggccgcactgtgaaccgtaggcgtccgggtcaggcctcacatgtctatgtaagataatggtgtcatataatgatatggttctgatcagttcggatttcatcgttttctccttttcgtttttattcatttaatcatactctttatccatggaaaaggaaaatctttcagcaacggtataaacggttttgcaaactcatataatggaggatttcatttatgctggtttttgtttttctcatcgggctttctgcctgcttttacgtgtattacaaagtaaaaggaatccagacgaaacgggcgctggagaaggaatgtttttcggctaaatcaagtatggcattaggcgcgctggtgcttttgtacggagtaaaccaaatgattctgttccactccgtcctgaccctggtcatcggcggcgtcttcattttaatcggagcaggcagcgcatgggccgggtataaagcctataagcattatgagcccatccatgcaaaggaagcggagagggaccacgcataatgaatgccaagggacccgggtgtgtcccttaacttctctccatcagctgcaccatgagcatcgcttttgaaacgatgccgctttggcttgacacttccacttccattttcccgaatttccggcccgcctctaaaatgcgcggtttcacttctatgaccgactccatctgtacgggcttcaggaagaaaatcgtaatgctttcaatgaccagctcgccgcgtttgcgggaacgtaaaaatcggctggcggcctgggttaaaatcgttgtaaacaccccgtaagaaatcgtgccgagctgattggtcatttgcggcgtgacttcatattgataaacggccggcgttttgttatcttcctcttctttaaatccccttgaaacaatatcatccagcttttctccgacctgaggctgcttttgaaccatctgaagcgcttttaagacatcctggcggctgatcattccgatcagtttgtgatgcccgtctgtcaccggaagcacttcaattccttcccaaaccatcatttgagccgctgaggcgacagatgtttttccgatcaccgtgacagggtttttggtcattactttttcaatgggaactgaccggtcatgccccgcgatatctttcggtgtgaggattccgtggattttcatctgctgatcgataaccggaaagcggccgtgtccggtttcatagttcttttcgtaccatttctccagtttatccttagggaacagcgtcactgtccgatctgcgggcgtcaaaatatcttccacgagcacaatctctttttttatgagctgatcatagatcgcccggttgatcatcgcggctaccgtaaaggtatcgtagctcgtggagagaatcggaagctcaagcatatcggccagctcgataatgctgtcgtcggtattaaaccctcctgttaccaaaacggccgcgcccgcttcaagcgcctggcggtgggcgttgattcggttcccgacgattaacaggttccccgcggccgtataacgcatcatcgcgtcaagctccatcgccccgatcacaaacttattcaacgttttatgcagaccggcttttccgccgagcacctggccgtcgatcacattgacgacctcggcgtatgtcagcttttcaatattttcttttttcttctgttcaatccggatggtccccacacgttcaatagtggaaacgaatcctttgttttcggcttccttaatggctctgtaagccgttccttcactgactttcatttctttcgcaattcttctgaccgaaattttttcaccgacaggaagcgaatctatgtatgataggatttgttcatgctttgttgccaagcgtttcacctctaaggacagtcttctgcttttattataagggtacgggggattcattcgcaatgagacgcccgaaaaaaggcggcatcacaaaaaagaccttctgaatgcttgattcagaaggtcttcgacacatatgtcaggcaagctcaatggtctcgccgaccgccatgactttgccgacgcctccgggcagactttcagcgaaagcgtcagggtcctgttcaatgacggggaatgtattgtaatgaacgggaacgacctgtttcgctctcagccattcagccgcgagtttcgcatcttcaggccccatggtgaagttatcaccgatcggcagaaacgccaggtcaatgtgattcagttccccgatcagtttcatatctgagaacagcgccgtatcgccggcgtggaaaatcgttttgccgtcaatcgttaataaaatcccggccggcatcccggtgtatgtgatggttttgttttcttcatcagtgaccgccgatccgtggaacgcctgtgtcagttttactttgccgaaatcaaattggtgcgcccctccgatatgcatcgggtggacctttaaacctttaaagccgagataaacggccagctcgttcggcgcaatgacgagcgcatcgttttgtttggcgatctgctctgtatctccgacatggtcattgtgtccgtgagtaagcaggatgacatccgctttcacttcttccggtttcaaatttgtcagactgtttccggtcagaaacggatcaaaaataatgttatgggttttcgtttccacttgaatgacagaatgtccgtgataagtcactttcatcgttttcacctcataaaaaattaatatttatcaagttccctttttgacaaacgaaaaaacttacagggattgatgcctgttaatcacattcagcccgcctgttgcttcaatgaccgttccggttacaagatcggaatcttcttcacataaaaacgcgatgattctcgcaatatcctctccggttccggacctgccgatcggcgtcttttctttgccgattttccgtcttgcttcctctatagacgcttctttcatatctcctacaatatcacccgggcagaccatattggctgtaatgcctgattcggcttcttcaatcgcaatggttttcgttaacgaagccaatccgactttagccgctccgaaagcggaacggtgaagccagccgggggcatggtccgctccttgaaaaccgtatgtaataatccggccgaagcgctgctgtctcatgaccgggataaccgctttaaacagatggaaaacggcgcttaaattcccttcaagcatgccataccattcgtcatcggagtaatcggcaagctttttgcgctcaaatatgtacggcccggcattgttaatcagtatgtcaatccttccaaaccgctgaagggctgcatcggcgatccgcatgagatcttctttccgggttacatcgcccttaacgaattgcaatctgtcatggcacccgggataatccgccttcagacaagcgaccgcttcttcgtcctgtctgtaattcactgtgacagaaaagcctttttccagaagcatttcagtcacttttcggcccaatccctttgtaccggcagtgattagagcatgtcgcacattgaataccctccccaggcaacgtagccgcttcaataaaatcaaggtttctccctctactttactataaacaaacggcaatatcacttttttgcacttcgtccgcacgaaaaaaaagccgtctttacagacagcttaattttctgaaggagcagaggcttcctccatgccgacataaccgctttggtatgcctctgagataagcctggccgtttcttcactttctttttcatcatagatgtaacggtcttgttctttgcgcattccttctacctcccatcttttatagatgtagggtgtctgatatgacgggaaaatatgaaggaaatttcagcaaattaaatgccggcgcaggcttttgcttttacgagcgcctgttctacctgctgaaaacccgttccgccggcgctcattcttttttcaaccgcatgatgcggatcgagcacggtatagatatcttcttcaaagagactgctggcttgaaggaattcttcaaatgccatgtcacttaaatagattcctttttcaatacagctgtacacaagcttgccgaccacttcatgcgcttctctgaacggcatgcctttttttgctaaataatcggcaagttccgtcgcgtttgaaaaatcttgttttgtcgcttgtttcatgatgtctttgtttactttcatcgtttcaatcatgcccgtgaaaatctgaaggcttccttcaacggtttttactgtgtcaaacatgccttctttatcttcctgcaggtctttgttgtaagcgagcgggagtcctttcataattgtgaaaagacccatcatatcaccgtatacgcgtccggttttaccgcggatcagctccgccatgtcggggtttttcttctgcggcatcatgctgcttcccgtcgcgtacgtatcatccagttcaatgaatctgaattcctgcgagcaccatagaatgatttcttctgataaacgtgaaagatgcatcatcagcatgctgctgccgcttaaaaactcgagaataaaatctctgtcactgactccgtcaagactgttctcgtaaatggagtcaaaaccgagcagctccgccgaatagttacggtctatcggaaacgtagttccggcaagcgccccgcatccgagcggcgatatgttaatccgcttcatagcatcccgaaaacgctctttatcccgttcaagcatccaaaaataagcaagcagatggtgggcgaaagaaatcggctgggcccgctgcaaatgagtgtaccccggcagaatggtctcgacattggcctccgctttttcgatcagcgctttttggaactgttcaatcagcacgatgatatgcgagacatgatctttcaaatatagatgcatgtcagtcgccacctggtcgttccggcttcttccggtatggagtttgccgcctagcggtccgatttcttcaatcagcattttttcaatgttcaaatggatatcttcataatcaacagagaattcaagcgttccttcctctgctttttgcaggagagtctgcagcccttgacggatggcaccttcttcttcttccgtcagaatgccgcattttttcagcattgccgcatgagcgagagaccctgtaatatcctctttgactaagttttggtcgaatgtgatggatgcgccgaactcatcgacccacttttccggtgttttttgaaaacggcctccccaaagcttcttcatgcttcaatctgctccttctttttcacaatgctgtttacttttgtcggcagcccccaaagctcaatgaaaccgattgccgcgtgatggtcaaacgcatcgtcttttgtatatgtcgcaagtttttcgtcgtagagagaatattccgacttacgtccttctacaatggcatggcctttaaacagcttgacgcgcacaacgccggtgacgtgtttttgggtttctttcaggaatgcaagcagcgcgtcttttaacggcgagaaccataaaccgttatagatgatttcagacagtttttgttcaattgccggtttgaaatgggccacttctttcactaaagtcagatcctcaagctctttgtgagccgtaatcaaagtcatggcgcccgggcactcataaacttcacgggacttaatgccgaccaggcggttttccacatggtcaatccggccgatgccgtgttttccggcagtctcgttcagcttgagaattaaatcagcgagcgggtaggttacgccgtcgattgaaaccggaacaccggcttcaaatgcgatttcgatgatttccggaacgtccggcgtgttttcaagagatgctgtcaggtcatatgccccttcaggcggcgccgcccacggatcttctagtataccgcattcattagcgcgtccccataggttctggtcgatggaatacgggctgtcaagattgatcggaatcggtatgccgcggcttgcggcgtattcaatttcttcttcacgcgaccattgccactcacggaccggagcaatgacctccagatcaggatttaatgatttaatggatacttcgaaacgaacctgatcgtttccttttcccgtgcagccgtgcgctacggccaccgcgttttccttttccgccacttcaacgagttttttcgcgattaacggacgggatagtgcagatacgagcggatacttgccttcatacattgtatgggcctgcatagaaatgagcgcgtactcccgggcgaattcttctttcgcatcaatcacataggaatttacggcgccaacttccagcgctttttgctgaacgaatgccaaatcctttccttccccaacatctaagcagcaggcaacaacatcgtatccctgttcttgcagccattttatcgctacagaagtatcaagacctcctgagtatgccaatacaacctttttttgttctgccatgttaaaagctccctttgtataaaaattagttttaattaataaaaatgcattttgtatgtatacactgtaacaagtaaattctgttttttcaagccttttataaaaaaaaccccacccaattttttgagcggagcggagcctttttatacatttataaatcttttcggatttcccggagcacatggggcagttcaggaataatcagtttactcattgcaagctttacggcgcctgaggagccgggcgtgcaaaagactgcggtatttcggatcacacccgctgccgctctggacaaaatggcggccgagccgatgtcctccgtatagctcagcatgcggaacagctcgccgaaccccgggagttcttttgaaaacagcggcgtgaccgcttcaattgtgacatccctttcggcaatgcccgtccctccgtttaacagcaccgcatctgtatattcatccatacagccggataaaacggctttctgcaattcatctttttcatcttttacaatgtcataagcgaccgtttcaaatccagcttctctgatgaaatccatcatgacgcgcccgcttttgtcggtttctttcgttctcgtgtcgctgactgttatcaccttgcagcgcacggctgacggggcttcttgtttatgttcatgcacactcattgcttcacctcatcgtttatgtattaaacatatcgtaacgtttgattctggggcattcaataaaaaagcacaccctaaaggatgtgcttttttcgctcattactgtgcaagacggacaacgtcacgtgcgatcatgacctcttcgtcagtcggaatgatgatgactttgacaggagagtgagggtagctgataaacgcttcctcgccgcgcacgttgttcagcgcaggatcccaatatacacccatgaattctaagccgcgaagcacgcgttctctgacttcaacgctgttttcaccgatacccgcagtgaaaataatcgcgtcaacgccgctcattctcgcagcgtaagaaccgatgtatttatggattctgcttgcaaacacttcaagagccgtttccgctctttcgtttccttcttttgaagcttctacgatatcgcggaggtcgcttgagaaaccggatatgccaagcagtccgctctttttatttaatgtatttaatacttcatctgccgtctgatccgttttttccataatgtacgggatcaatgcagggtcgatgtttcctgaacgtgttcccatcgcaacacccgcaagcggtgtgaagcccattgacgtatcaatggattttccgccttctacggccgcgatacttgcgccgttaccgaggtggcaggaaatcagacgcaaatcttcaagcgggcggccgagaagctcagctgcgcgctgtgtcacgtatttatgagaagtgccgtggaaaccgtatttgcggatgccgtatttctcgtagtattcgtacggaaggctgtacaggtaagattgctcaggcatcgtttggtggaacgccgtatcaaacactgcaaccgcaggcacatccggaagcacttctttaaaggctttaatgccgacgatgttagccgggttatgaagcggcgcaagttctgaaatctcttcaatctcacggattgtttcatccgtaagcaaaacagaatcgctgaatttttctccgccgtgaaccacacggtggccgattccgtcaatttcgtttaaatcctttataataccgaattcagtcagcttgtgaagcagcatcttcaccgcaaccgcatgatccggaatatctgtcacttctgtatttttttcgccgttaacagagatagtgaaaacgctgtcggcgataccgatccgttctactaaaccttttgttagcaccttttctgaaggcatttcgaataactgaaattttaaagatgagcttcctgcgttaattgcaataattttagacataaatgacgctcctatcaaaattcttcttcgtttgttcgttcttttttcccagaccataactgcggtccaaaaaatatctgacttttccatttaaacattgtcaactcagcatttcaagtcaacatccacattggtaccgcttacaatatgaagtcgatattttctgataaatctcatttgtgccaaatggacggcacggccttacggaatgttattttctttccttaatttgtgttttcgccctgatttccattcattttaaaaagcgaaaagcagcgcggaatttttgcttctcacactgctttttcgccattatttttctttttgaatccactgatccaattttgccatcatctcccgcatcgcctgctggttcgcaaaagaaggaagattcgccaaaagcgcttgtttcggcggctttgcgtcttcgccttttttctgcaggattaaaatgctctttgcctgcgcttcatctttaaacatagtagccggcagctgaagcagggcgttgatatatactttttccgcaaaaaaccgcttcagtttatcgctttgcgcgctgtcaaacagatggttcggaatcataaaaaataagtatccgcccggttttgtatgtttgacgctctgctcaataaataagtggtgagcaaatgagtggccttcatccgctttcagctcaaacgcttcagcgccttcgtcattgggatagtagccgaccggcaaatcgcagataaccgcatcggccggttcgataaataacggctgaagactgtcctggcagaacagctccatttctttttcctgcagattcgcctgcgcatatgcgatcttcagaaggacatcgtcgatttcaatgccgaagctttttcccgctttgtcagaaagctggtttgccgcggtcagcagaagatttccggtgccgcaggcggggtccagcaacgtcaggccttttcggccgcccgtaaatttattcacgaggtaactgatgaaaaggccgatcgtatcaggcgtcatctgtctgttcggatgggacttatctttcagtccttttaaaatggcgagctggaacgccttgcggatccattcatgctcccattttctgaagtctgctttcgcaagcaggcttttaagctcgccggtgtgcttttcctgaagcggaagctgctccgttgtttcaagaaaatacatctctcccgcctccgcaagcccctcaatataagaaatctcaaggctttctgctatcacttgggcggcttcatctaaaagttcataaatctgaccgacatggtcgtgttgcatgctgtttcctccttgccatgaaaagagctccgcggcagcacccggagctctttttctctctttacttgattaacgcttttgcagcgtcgataggcttttcataattcgggtggtttgtcgcttcgcttacgtattccgcgtaaacgacttttccgtcctgatcaaggacgaatacggaacgtgccaaaagacgaagttctttgatgtaaacaccgaatgcttcaccaaatgacatctctttatgatccgataatgtttccactttatcaattccgttcgctccgcaccagcgcgcttgtgcaaacggaaggtcggcgctgattgtataaacgttcacatcaccaagttttgcggcttcttcgttgaagcggcgtgtctgcgcgtcacatacgcctgtgtcaatggaaggaataacggatatgatcgttactttccctttcatatctgctaatgtcttctcttctaatccgtttgtcaaaaccgtgaagtcaggagcttggtcacccggtttcacttcttgtccgatcagcgtcacggctccgcctttaaatgtaatttcagccattctgattcctccctttatctatgtatagctctatcatagtcgagttttatgcaaactgcaaaggttatgccgcatcgtaaaaaaagctaactgcgggcggcagttaacttttctgttataaatcgatatccgttcttttttggttccggcctttttcattctttttaaacatatgctggatgcgttcaatcgtttgaggcgcggagtctaacagtttatcaatcagatgggtgttttcgtctaaatgaagcatacgcacgccgtttgttccgacaatcagaaacgcaatcggcgtaatggatactccgccgccgcttccgccgccgaacgggagcttctgctcttttctttcatcatcatcggttcttttttcagccggctttcctccaaactcgcttccgcccgccgcaaatccgaatccgacctttgaaaccgttaagattacgctgccgtcaggcgtttcaacaggatcgccgatgattgtattcacgtcaatcatttcttttaaattttccatagcggttttcattaaaccttgaatggggtggtctgccatatgcgctcctccttaaactgatgaatcattctttgaagcaaccggaaccggctgtttctttcgtatgatagaaagtccgttccgcccgtatttgagcaatttgaaagctgcacctataagatgtccaaaacgaaaaaagaatatacactgcaaatgcgtcttggatgcaggcacttgaaaagacggaatgacttcgcacaccggtttatgtatgaaacgcagatgatcatacagcatcgccgtaaggcctccctttacggcccacaatccgccggcggcgattcccgtaacggcggcgtcttttattccgataaccgtcacccattcaaacttcgtaacacggactcccgcaagaaatgaggcggcgatttggcgcatctgaaagacttggtgcagaatcatttctattctgtgaatgctctgtttgacatcttcatatgtgatttttttcttctcttttttctgacctttcatttctgatttcgtgtcctgtttgacatcaatagacgcgtcttcgctgtttactttaatgacgggcagcgtttttttaaaacggaccagcccgtataaggccgagagtttatacgtcagtttgtcgttatctttatcgtgaagatattcgaaagtcagatagattttcatcctcatgagcagccagaccaaaatgagaatgagaattacagctgctgcggcatatcccataggcttcacttccttagcagcattatcgccaaaaccaaaaaaaataaacccggacgtttattccgggtttactgcttttatttgcggtacagcgcttcgtgaatcaccgttgtgtcggcgatcaaatcgtgaatgccctgctttttgggcgtaaacgcaatgacgatatagagaatccagattttatcgatatatcgccccaccgcttctctgaagatgacggtgctccaagtcagcggctttccgggcgtcaaagaagtgacctttaacccgaagaccattttgccgagtgtctgatgaaaccatttcgtcatgaacacaaaataggcgaggtagacgatcagggttgtgacggaataagctgagattgtaaacattccgcttgttgccgggagcttcatcagcgtgaaaatcggtgaaacgatgagatggttaagtccccagaccaccagccaatcaagaagaaacgcccaaaacctgatccaaaagcccgcatatgcctgctcgggcgccttctgttgttcggcttcctcttctttgccgtgaaagccttcgtaagtcgcgtccattctttcttcccccctactttgcatagagatacatcatccgcggcgaaccggattgcgaaatgagttctttcatattcagaaaatcaatttcgcttttaaacattttcgctgcgctcatggaaaagagcgagcctaatccgaatccttcctcgtatgtgatgactgaagcgtttttcatatttttatggtcctttttcatcgcgctgatcgtatcatcgtaaaaaccgagctcatcaacgaggccgatttttttcgcttgtctgccgtcgtaaacacggccgtcggcaatttttttcacatccgcttttgacatgtgccggccttttgaaatgacattgacaaatccttcataagaatcgttgaccattgtctgcatgatctttctttcttccttcgtcatgtcgcgggtcggggacatgatgtctttatgcgcgccgcttttaatggtttcaaacttgatgccgagttcatcggcgagcttggaataattgacgctttccatgatgacgcccagtgaacccgtgagcgtttccggtgaagcatagattttatcggcggccgttgaaatatagtagcctcccgatgccgccatggagcccatggatacataaatcggtttcttcgtttctttctttagttcttccagttttttatgtatttccgcgctttcgtacacgcctccgcccggggaattgattttcagtacaattcctttgacgcttttatcttctttcgcacgctcaacctgttttaaaaatgatctgtgatcatacccgcctgagctgagcaggccagcggacccgccgttatcctcaatcgtgccgtccacttcaagcacggcgattttactgccggggctgcccttatccagcgtcacttcctctgtgtcatctgtcagtgatgcaaagtcagaccctgtatctccgatattcttcagcaccccgacggtcacacttgcaatgaccgatacgccgaaaatgccgagcgcgatgacgagcgcaatccatctttttgcattcatttgttctcctccttttctgtcaatattcgtacgttcccccgtaaaaaaagattcatttttttcatgaagcgctttctcttaacggataaacaggaaacatgttacactattgccacaggtattttaacacaatacctgctgggagaaaaacgtaaatatgacagcaaaggggaatggggatatgaccgatcttcgccgcaatgtttatttttttcacaaacaaaacaacgaaacaaaagaacaagtcagctctttgaagcagcttgctgaatcgcacggttttacagttgcggctcacccggaggatgccggtattatcgccagcatcggcagcgacggctcatttctgcaagccgtcagaaaaaccggattccgtgatgactgcctgtatgtcggcatcgctaaaaaagggaaagcccatttgtactgtgattttcacagcgatgagcctgaaaaaatggcggccagcatgaccgcggaacagcttgaggtcagaaaatacccgctcattcacgtaacggtggacggcagcaatcattttcactgtttaaacgaggtttccatccgttcaagcattattaaaacgtttgtgatggatgtgttaattgatgatcttcattttgagacgttcagaggagacgggatgatcatttccaccccgacgggcagcaccgcctacaataagtctgtctcaggcgccgttgttgatcctttgatttcctgcatgcaggtatccgaactggcgtcgttgaacaacaacacataccgtacactcggatctccgtttattttaagctcagaccggaagctgacactgcaggtggtccaggacggcaatgagcatccgattatcgggcttgataatgaagcgctcagcacgcggaatgtcaaaaaggttgagattacactatccgataaaaaaatcaaaacggtgaaactgaaagacaactctttctgggaaaaagtaaagcgatcatttttatcataaaaaaagaggacgggcatcactgcctgtcctctttttcatatacgatacggccgccgacgacggttttgacagcttccaattcatgaagctttttcggatccgtcccgaacggatcaccgctgagtacggtaaagtcggcatcatagccgggggcgatccgtccgcggctatgttctttatggatgatggccgcgcttccctccgtgtaaagctgaatggcttcgtacacggtcaggcactctttttcataataggccggaccttccggatgctgcttgcttgtacggagcacagccgattgaatgcccagaagcggatcggccggctcaatcggggcgtctgagcctccggcgcacagcagcccttttgacagcagtgttttccaggcgaaagccgttttcatccgctcttctccgagccggtcaatcacccacggaaaatcactggccacaaaatgcggctgaagatcaagtccgatcggcagccgggcggctctttcaatcaatccggcatctaatacttgcgcgtgaatgagcctgtctagctgtccgggctttgccgggtatctttcgataacatcgagcaccttttcaaatgcaaggtcgccaatcgcgtgcacggcgatctccatccctttctctctcgctttataaacaagagcggcaagggtctcgtcatcgtgcacctgaacgccggaaaccgacggatcatcatgataaggctttttcaacagagcggttctgcctccgagcgcgccgtcagcaaaaattttcatcgctccgtattccaggtaaggtccggtcgatttatccagagcgctccagctgtcgacggcttcgtgatgaacgagcagatgggcgcgaaaaggataaaggccgctgccggttaaagactcgtacgcggcaacgggaacggacgcgtctccgtagtatgccagatcttctgaatgcccgccggtcaggccttttgaccagcagtccgtaatcgccgtttgaagcgcgcgtttgacatagtgaagtgtgacgggcggcagggcctgtgtcacaagctcttgggctttatccagcagaaggcctgtcggaccggtgccgtcccggacgataatcccgccgtttggatcagatgtttcgtttgtaatccccgccgcgcgcaatgcggctgaattaaccgcaacggcgtgccggcatacccgcttcagcaggacggggcggtcgggaaagagcgggtcaaggtcatgcttcgtgacgtaatccggccgttcaaacaggttttcatcccagccttcgccgatcagccattcgccatcttccaattcacgctctgcttcttttgcggcccgcagaatcgcttcttttgacgtcagctgcgacaaatcgaggcgaagctgtttttccccgtgtccgattaaatgcatatgactgtccgtaaaccccggaaacatgacagctccatgtaaatcgatttcctccgtatcaggcgaaccgtatgttccttggagctcccgatagctgcccgtctgcctgacgacgccttcttcggtataaacggattcagtgacatgattcttgtcaagcattgtatagatggtgccgccgtgccaaatcgctttcatccccgctcaccctttatcctgtattatgcttttttatcagccttcagccgttcttcacgctgtctcagttccacacgtctgatttttgcggacgccgttttcggcaggctttcgacaaattcaatttctctcggatatttgtaaggcgccgtaatcgtttttacgtggttttgcagttctttgacaagttcgtcactgcgcttttcatcgtcttgtaaaacgacataagcttttacgattgaacctctgatttcatccgggcttgccacgactgcacattctttcacttccggatgcttcacgagcgcgtcctctacttcaaaaggcccgattgtatatccggagctgacgataatgtcatcattgcggctctcaaaccaaaagtagccgtcctcgtcttttttcgcgcggtctcctgtaagaaagtaatctccgcgaatctgctttttcgttctttcgggatctttataatattccttgaataaggccggtgtgctcaaatgcacggcgatatcgcccgtttcgcctgtttcgcatatttcgcccttatcgtttataatctctacttgatttccgggggtcggtttgcccatgcttcccggcttaatatccatatccttcaggacgccgactaacagggtgctctccgtttggccgtatccgtctctcactttaataccgaaatgcttccggaatacgtcaatgacttcccggtttaatggctcacccgcagaaactgcgctgtgaagggcagaaagatcatatttgtccaactcctccacttttgccatcaggcggtattccgtcggggtacagcagaagacatttacttgatggcgctccagcagctctaaatacgtcttggcgttgaatctgccgtgataaatgaatcctgtcgcgccgcttcccagaacggcgagcagcgggctccacacccatttctgccagccgggcgccgcagtggcccacactgtatcgtcttcggaaatatccagccatgcaccggctgatgtttttaaatgggcaaaggcccagccgtgtgtatgtacaacgcctttaggctggccggtcgtgcctgaagtataggacaaaaacgccatgtcctctcttgttgtatcagctgtttgaaaactgtttccgtccgcttcaatcgttaagaggtttttccagccggcatcattttcaccgattgacaatgtcaccagctgctcggtattcacctcgtcaaatgcgtttataaatgaaggataaacgatagcgcctttcacttcggcgtgtttgatccggtattcaaggtctttggcgcgcagcatttccgagcaaggaatgacgaccatccccgcttttaagatcgctaaataaacggcatacgcttcaagcactctcggaaccatgacaatcagcttatcgcctttttcaaatccgagacctttcaggcgggctccgattttattcgtttcttccatcaatttttcatacgtccagactttcttgccgcctgtttgatcttcccaaataagcgcgttcttctctttggaacggctgaacttttcgatttcatttacaaggttatagttctttggggcgattaaatcttctcgttttaacacgaacaactcctcactttctttccccattatacataaacataggccattacaataaaaatatgcataaattgcttccagccttctatctatactcatgaaaaaagagcggggaattccccgctctcttagccattatgtgaagttgtgattaaaactgctgctggctgcttccgcccatgctttgctgagcaaaagagacaagacgttttgtgatttctccaccgacagaaccgttggcgcgagaagttgtttccggtccaaggtttacaccgaattcagaagcgatttcatacttcatttggtcgatagcttgagcagcgcctggcactaaaagctggttgctgtttccgctgtttgattgttgtgacatgtgtatcacctccttgtgagtatagaatgtgataaaacacatgtcttcattcaaaaaaactttggtaattgtatacagttttaaaacaggccggcaaacttatcgtgagcttcctgctctgagtaaacagtgatggtttcgatgccggcagcggcctctgcaatcagcggttcaaaatcaacgaagctttcgaagtgctcgattttttcttttttcggacgtgttttcggacttggcggcgtaaagatggtgcagcagtcctcaaacggctgaatgcttgtttcataagtgccgatttcttttgatttctcgatgatttctgttttgtccattccgattaaagggcgcaaaaccggcgttgccgtcacggcattgatcgcatacatgctttcaagcgtctggctcgctacctgcccgaggctttctcccgtaatgatcgcgagcgcttttcgttcttctctgattctgtccgcgatttgcagcataagacgccgcgtcgccgtcatcgtatagttttccgggatttgtttttggatgagttcctgcgtctttgtaaacggcacgatatgaagcgtcatactgccgccgaacttcgcgaggcatcccgcgagatccatgactttctgctttgcccgttcgctcgtatacggcggactgaagaaatgtacggcttcaactgataatccccgtttcatcgcgtaaaaaccggcgaccggactgtcaaaaccgccggaaagcatcagcatcgctttacccgcggaaccgacaggaaggcctccggcgcctttttcgttacgaatggtcaggaatgtcgcttcctccctgatttcaatccgaagcggaatatcgggatttttcacatcgacggttaatccatccgtgtttttcaaaatatggccgccgatttcagcgttcatcgcattcgtatctaattcaaactgcttgtaagcccgtttggtctcgaccttaaacgtattccccggtttatattcgccttctatcgcggctaaagccgtttttttaatgtcttccagcttgctttcgcatttaattgcgagactgaaactttgaatgccgaatatattctttaataaggaacaaatttcctccgggttttctccattaagtgtaattgacatccggtcccggtttgaaaagtattttacttttttataatcctttaataccaggcggatattttgttttaatctttcaataaaactgcgtctgttttttccttttgtggatatttcaccaaaacggattaaaatatgatcgtaattcatatgctacctcatcattttttttagtttttgaacagccggcaccagcgcggccataaacggctccgtgatgtcagccgtatggctgaagttcaggctgactctgatgctgcttgatgcaacctgttcgcctttattcatttgcagaagaacacggctcggtttgtgctctcttgccgaacatgccgcggttgtggagacatatattcctttttcctcaagcatgtgcagcagcacttcggccttcacgcccggaacggaaaaattaatgatatgcggagcgctgttttcggcgggagtgttgatgacgaccccgtccgccccgctcagcctttccatgagcgcattcttggcagcttccaaggaagaaagccgctcattcatgtcacgcgcggaaagattgatcgctttcgcaagggaaacggcgcctgccgtatgttctgttccggcccggacgcctttttgctgcgagccgcccgttataagcggaatgagccgcgttccttttttgacgataagcgctccggtcccttttaagccgtgaaacttatgccctgaaacagtgcaaaggtcaatgcccgcttcttctatagacagaggaactttatgaatgccctgcacatgatcaacatgaaacagaatattccggtgctgcttcaaaaacccgccgatttcctttacgggctgaatggagccgacttcgttattgacatgcatgacgctgacgattatcgtatccggcctgatagccgatttgacgtctttcaaagaaacgaagccgttttgatcggccggaagatatgtgacttcaaagccgaacagctctgtcagctgatcaagcgtctccgtcacagaaggatgctcaatcgccgaagcaatgatatgtcttcctttactcatgtttgcccaggccgctccctttaacgcagcgttattcgcttcagtcgcgcctgatgtaaatacaatatcataattttttaaacgtaaggttctttttatttgctgagcggccgcttcaaggagctgctccgtctcagttcctaactggtgcagagacgaaggattgccgaaataacggctgctcgtctgtttatacacttccaaaacctcttcatacggctcggtcgttgagctgttgtctaaatatatcatttttttttactccttttatgaaaacggtacatcgtatgatatttatgctaccataacaaaagtaaatagaaattcgcaataaatcgagtattgacttctctgtacattgccatataataagtaatgttcgttttgttatattatctgacaattaattgacagaatatttcaacatagtatttaggaggacttttatgaaacactcactacctgtcaaagataccgttattatcggtttcatgctcttcgcactttttttcggggcaggaaatatgatatatccgccggagcttgggcaagcggcggggcataatgtctggaaagcgatgggcggtttcttactgaccggcgtaggactgccgcttttaggtattatcgccatcgcattaacgggtaaagacgcgaaaggacttgccgataaggctcacccggtattcggcactattttcaccgttgtgctttatttatcaatcgggccgcttttcgcgattccgagaaccggaaccgtttcatatgaaatcggtgcagttccgtttttaagcggcattccggaaagattatctttatttgttttcacgttgatctttttttctattacgtattatttagctcttaacccgtccaaaatcgtggacagagtcggaaaaattttgacccccattaaattcggtatcattttaatcattgtcgtaaaagccatcgtcactccgatgggcgggctgggcgccgtacatcaggcatattccggaacgccggtgttcaaaggatttttggaaggctataaaacaatggatgcactcgcctcaatcgtcttcggcgtcgttgtcgtcaacgctgttaaaagcaggggcgtcacccagcgtaaagcgctcgcggccgcttgtattaaagcgggtctgattgcagcggcgggtttgacattcatttatttatctttggcctatttgggagcgacaagcacggacgctgtcgggccgctcggcgaaggcgcaaagattttatcagcttcatctgattacctgttcggttcactgggaaacatcgttctcggtgccgccatcaccgttgcgtgtttaacgacaagcatcgggcttgtcacatcttgcggcgaatatttttcaaaattgattcccgctttatcatacaaaatggtggttacgattgtcacgctgttcagtctggcgatttcaaatttcggacttgctgagattattgcattttcagttcctattttatcagccatttacccgctggcgattgtcattatcgtcctttcctttattgataaaatctttaaggaaagacgcgaagtctatatcgcctgcctgatcggaacggggctgttcagtatcctggacggtttgaaggcagccggcattccgctcggatcattagattcattcttaaacgcaaatcttccgctttacagcatgggaatcggctgggtgcttccgggcattgccggagcgatcatcggctgcatcatcacgttttttatcagcccgcctatcgaattaaataaagcaaaatcgtaacattcagcgcctgcggtttgatgtatatcagccataggcgctttttatattccgtgagaaacaaaaaaactgcacctctgatttccatcagggtgcagtttttgcttgtgcgtctatgaagcagattgatcagctttaatttttttcacggcgccgggagctgctttttcaacagcatctgccgccatctcataagcttcattatagctgtaagcgtaaaacagccgttccgcttctttcagctgttcggataaaatatgattctggcttcggaaacggttgccgtactggatgatccgctcaatcagcttcacctgaatcacaagttgttccgcctcttcgctgacttccgcaaccaccttttcagcttcggtcagatgtttggcggcttcctccatgtttaacggcagctcttccaattggctgacggtctcttctatatgatgatttgccgtctcgagcttgtccttgacttgttcaggaattcccggcacgttgcttttttgcagcattcgggccgtgtcagaaatggttttccgaagattcatcagcgtttcccgcgcctgcagttcttcttttctgagcgcctgcagattttcacggtattcggcatgttctttctgagcttcttccatctgcttttcgatggcctcgacttcttcaatcagcagagagtaagcgacatgctcaccgtcaagcttttctctcgcctgctcaaggagccggccgatcgtttccagctgtttttcgaaagcatgctgtctgccgatttctcccgccgtcagctgatagctttccttgacgagctccgtttcggtttttgtgcggtctttttcttcctcaagcttctcatacgcgatgatcagctcaggcattttgcttaatacggactgtccggcttccacttcgccttccagctgttcatacatcgattgaatggtttcatcaatcagctgaagaatggcggacgcttcgtcgacatctaattcttccaaaagcgcgctttcggcccgtttcaattgattggtgagtgtctccagctctttttcgatttgaatatgctccaatttgtagcctttttccgtcatttcccggtagccgtctttcagcttggcaatttggttaggcacggtctgtttacagtcagcgagcagtttcggaacgtcatctatgtatgtttgaagctgatccagtctgcggtcctgttcaagcagcacttttctcgctttgatgtaattgccgctttccgtctcttcttcgaacttttttatgccgctccagatttcgtcgagatccgtctccaggctgttatatagctctccgtagagatggctgtacgccagaaggttttttcgcgcttttgaataccgctcacgcacctgttcaatctctccgcggcttttttcctcgctcgtcacaagatcgctgatctcacgcagtatgccttctatatttgattcggctgcagtgaggaggtcgtcgatgtggacaagcacctgattcgcttttttaaaccggtatttgtcggcgttctcttcggcatcataaaggagctcttctactttcggcagatgggctgtgacaatttcatcccactcttcgcgccatctttcaaagaactcttccgtctctccggtcattttcagatgtttgatcttggacatttcttccactatcgaacggtttaaaatttcaatcttccatgactccagccggtcaatttccgtataaatttttttcctgaaaaagtagcccgccgcaaagagcgcgagcagtataaccaataatccgatgactaactccataatgagcccccttgttgttctcttaatctgtcagggtgttttatgtattcagaaagatttcaatatatgtattgagaaaatctgtcgttttcattgttattatgataccatgtaaccaacattttttgaccagaaatcaaaaactttttgcataatttcggcaggattctgcaattttttaatggagtgacacaaatggaaaaacgagacgctcatatccacacgcctttttgccctcacggctcgaaggatgcgctgaaagaatatgtcgaaaaggccctggaaagaggctttgactcgatcacatttacagagcacgccccccttcctccgtcatttcaagatcccgtaccgcttcaggacagcgcgatggatctcagacagatggaggtttatttggagcggctgtcacagctgaaaaaggaatacgatggacaaatcagcattctgaccgggctagaaactgattttatcacagggtatgaagaggaaaccgcggcgtttctgaacacgtacggcccctcactggatgacggcattttatccgttcattttttgaagaccggtccgtcttatatctgcctcgattttgacgagcacgcctttcagcagctcgccgcgcacttcggaagcgttgaagccgtatatgaacaatactatgaaactgtgtattcttccattgtaacaccgctcggcccctttaagccaaaacgggtcggccatatcacgctcgtcaaaaaattcgcgcgccttttcccttacagcatgtcacctcaaataagagagcttgcggcccgctgtcttgacgccgtgaaagaacacggaatggagctggatgtgaatacatccgggctcagaaagaagtttgccggggaagtatacatggaggattggatggctgagacggcgaagcaaaaaaaaatcccgctcatattcgggtcggacgcccatcaagcggaagatgtcggcagttcctatgaaacgtacaaaagcatcattacttcataagcgccgcatcaggccgtcggaacacgctttcgatccagatcttcacctcttcaaaataccttttataaaagtacggttcatgaggctgcatatagagcacctctgtaatgtattgaggctgaagatacggcatcatcaagagggatttcaattgcagaataaaatgcggcacgggcagcgtcagccgtctgtggcgtgactgcccttcttcaatcaccagctggaaaatatatttttctttcattaagtaagtagacataatttccctgataagcacggaatcaatcgtcacttcccggtacacaaaccgcgttaattgacggttatcgtgctgataggataaaatatcgaaaatcacccgcaggatgcgttcctgcgcgtcttcaccgttcatactgacggcggctttttccagcgcttcagtatagccttcgtaaaactcggaaactaaatgttccattaatccgcctttccctttaaaatagtaggagatgtgcgcaacatttacatcagctgactttgcgatttcacggacggacgtgccggaataacctttttggttaaacagctggacagcggcgttaataattttgtctttggtgcttactttcatacggctcacccctttatgtgtaacaattcaagcagaaaggcgccgttcctgtaagaacttctcgacaaatgccggcagaacggccggaactttgtttgatattatagaaaaagtgagggttttccatgtttcatgtcgaaaaacaatccggagataaagaaaaaagttatcagcttctgcttaaacagctcgaagccatgacagaagatgaaacggatgcgatcgcaaattacgcgaatgcatcagcgcttttataccattcattacatgaagtcaactgggcggggttttacttcgctaaagagggcgagctcgtgctcggaccgtttcaaggacttcctgcctgtgtgcgcatcccgttcggcagaggcgtatgcggcactgcctactctaacggcgccgtgcagcggattgccgatgtgaatgcgttcccgggacatatcgcctgtgacgcggcttcccagtcagaaatcgtcctcccgatccgcgtaaacggtgaagtgatcggtgtgctggacattgacagccctgtgaaaaaccgttttgatgaaacggacgaaacctatttagcaaagtttattgaaacgcttgaaaaacgattaggataaaaaaaggagcccggccggcaggccggctccttttttatgtcgtcgtgctgttttggtggatgatcagccggtttttgccgttccgtttggcgatataaagcgcctcgtccgcttgctgaacgagcattttcaacggcatcgggcctgtctttgaccagcaggaaacgccgcaggaaatcgtcacgcgcggctcggtgttttcccggatggcgcgaaccagccttttagcgatgcgttctccggatgacacgttgatattcggcagatagacagccagctcctcgcccccccaccttgcagcgacatcatgctcacgaatatggtttttcataacggaggccacctgaatcaggatcgaatctcccgtttgatgaccgtatgtatcattaatggttttgaaattatcgatatcaacgaggatgaatacaccccgtttatgaattttcatgctgtattgaattttctcatccaaataggttcttgaatacagctccgtcagctggtctgtctgaacaagatgctcaagcctgtcgcgcagcatggagttcgtgaccgccaatgtcgcatggtgaatgagcgcttgaaaaagcttatacatttcaaacgtaaaagcatacaaatcctttttcaataaaatcgcgaacccgaagacggtgtcattttcgatcatcggcaccgccatcagcgagccgaagccgttttcgccgaatacagtctttccgctgccgataaacacgcccttttctccctcgaacagcttttctttcacaatgctgatataggggttcgcacgttctgtcttaaaaaaagcggtatgtcccggaagcagattttgcgtctcaaaatgatcaatatgaaaaaaagccacttcttccgcatgaaatgattgggtcataatggcggcgagttcccgcatcgtgtcagtgagtctgaggcgctgattcagctggcgcgatgtttcattaatgagctccagattcgcaatgctttttttcgattgctcatagagctgcgcattttcaaatgcttttcccgccgcgcccgcaagcagcagcatttcactgagagtactgcacgaaagaacggcatcctgcagcccctccgtcttcagaaccccgtaagtcccctgctggcctttgatcggcaggtaagcagatgacctgccttttctgagcagtctccccgataaataaaccttcagggcagacgggtcggcatcttttccgtccatatgtaattcttttgcgggaagctgtctgtccgtatcctgatcctgcgtgataaacagtgaaaagcggaaagaccggaaagccgtactcaaacttgcctgcagtttttccaaaacctcattttgatccaaaagcgaatggaacatttctgtcattctgtgaattttccgctgatgcttcgttttgtcaaacagcccgctttgtctcacagattgattgataaactgagtaacgatctcaggcaatgattccgggatcggcagcccgccttccgagcgcagataaaaggatctgccggacgtctgattcctgatcataaaacggccgtcactctctttcagcggagcataatgcggttcatcttctgtttttatggtgaaacgtgttgattctgccggtgaaagggtcaatgaaagagatgtaaagcaggattctagagctgaggccagccataacagcgagtcggataatgagacggattcagatttcgttaagaaaaaagaaagcattttctgatgaaaggccgtcacttcatcaattgtttgttttttcatttttatcacctaaacatgtactactcatttttgtacattatatcataaaccggcactcttcatggagaaatggttgacggcggcggggaaaaatcatataatgttctttgtgtgaaatattgcagcctttttgttcagcttctgtgtttgcattttgttccttagctgtaaggtgtatcgtgtaactctctgctgctggagcgaggatacatgaaaacaaaatgtgcacggtcggatcgaacagacggtttttattttccacaaaataaaaccaaaggaggagtcacattatggctcgctatacaggtccatcttggaaactgtcccgccgtttaggaatctctcttagcggtacaggtaaagaattagaaaaacgcccttacgcaccaggtccccacggtccgggacagcgtaaaaaactatcagaatacggtttgcaattgcaagaaaagcaaaaacttcgtcacatgtacggtgtaaacgaacgtcaattccgcacattgtttgacaaagcggcaaaaatgactggtaaacacggcgaaaacttcatgattcttttagatgcacgtcttgataacgttgtgtacaagctcggtcttgcacgcactcgccgtcaagctcgccaattagttaaccacggtcacatccttgttgacggaagccgcgttgacattccgtcttaccaagtaaaacctggtcaaacaatcggtgttcgcgaaaaatcaagaaacctttctatcatcaaagaatctgtagaagtaaacaacttcgttcctgagtaccttactttcgacgctgaaaagcttgaaggtacattcactcgtcttccagagcgctctgagcttgctccggaaattaacgaagcgcttatcgttgagttctactcccgttaagtaaaacgctctttaaagaacattggattaaaccccggacatgttgtgatgacaatgtttccggggtttttcttttgggctgttccctctctttattaaaaaagcccctgtccggggcttttttttatgtgccaaccggcttttcaactacatgtacattagaaaaccccataatgcctgcaacagataatgccgcaaaaagaattctctttttcatcaaattcctgccgaaacgcagaaatgagtttgttattttttctgactcaccttaatcatttgacaggcagaagcgattttttacataatgaatcatcatacttacaaaaaggagagacggaatgaacagcatcccctctatcgtcagcaagcacaaagcctattttgcggcggggcatacgagaccgctagaatcaaggctgaacatattgcaaaagctgaaacaagccatcaaaacacaagaagccgatatagcagccgctctctatcaggatctccacaaatccgaacaggaggcgtacacgacagaaatcggaattgttctggaagaaatcagttttgtgatgaagcggctgagaaaatgggtcaaaccgaagcgagtcaaaacgcctctgactcacctgggctcgaaaagcatgattatccctgagccatatggaatcgttttggtgattgcgccttggaattatcccttgcagctggcgctttcacccttgattggagccattgcggccggaaacacagtcgttctcaaaccgtcagaatatacgcctgcggtttccgctgttctttctaaacttatcagcagcgtttttccgagtgattatgtcgctatggcggagggcgggcccgacgtcagcactgttttattacagcagccctttgactatattttcttcacaggaagcgttgccgtgggaaaaatcgttatggaggccgcctccaaacaattaattcccgttaccttggagctcggcggcaaaagtccctgcattgtccataaggatgctgatatacagcttgccgccaaacgcatcgtcttcgggaaatttacaaatgcagggcaaacctgcatcgcaccggattatttagttgtccaccaagatatcaaaacgaagctcatagaagaaatgaagcatgcgatcagtgaattttacggccctcagcctgaacaaaatccgcagtacggcaaaatcgtcagtgaacgccactatcagcggctgctcagctttctgaatgatggcgtcccgcttacaggcggacaatttaatcctgaacaccacaaaatagcgccgacgattctagatcaagtgaaggatgactctccagtaatgcaggaggagattttcgggccgattcttccgctgtttacatacggcgatatcgatgaagtcatcgagaaagtccaatcacgcccaaagccgctcgctctttatgtcttcacaacaaacaaaggaatcgagcgaactgttttagagaatctgtcatttggcggcggctgtgtcaatgatacgttaatgcacgtcgcgacaccgtatttgccattcggcggcgtcggagaaagcggcatcggcagctatcacggatttaacagctttaacgcatttacgcacaaaaaaagcgtcgtcaaacaaacgaaccgcttcgacctcgctttccgttatccttcttccaaaaacgggctgcgaatgatccggaaaatacttaaataaaaaagcgcagagtatctgcgctttttataaatcatctatacaccaattaatcggttcgtctcccaaattaaacctatttttaaaagttcaaatcgaagtctaaccgcaaaaatgaaccaacccaactgtaggaaaggttaatccttatcaccctggtgagtcctataataattttcagcggtatagatattccactcccaaaaatttgctccttgacacaaaatataccgatctaaaaatatctcaaaattaagtttcattggttcatactcaataaatccgcggaaccataaatagtttggatctgtagaaattttggttttgtcaattaacaaataacatccgtctaacagatgtgcgacaggaataaactgaggctctaaaaaaccattttgcatatacttttcaatctcttctaaatcaagaatatgcaaacccccacctacattctcaccgtaaatcaacaaatcaaatattctggctccgttatgcaattttaaaaaggttttataatcttcaggaagtgagacttttattttcttctcaaaactctcaatctccagatctgttgcacctttaaagaaagtacattctgtttctaaaagcgttccttcattccctaaaatgttcaagcggcctttttcatcaattaattcttttagaccttggagcgttttttcaacaaaaactgccattgagccacctcttattattagagcattgctattttattcacaagagcaggagccaatgttccagttgaagtatcaggaagagaacctttccatccggctactgaagtatgttgggacataaaaaactttgtctttttaggataatacgactttgaatatgatttacctgcttgaaaattctatgttatggggaaaacctttcgtattaaacatataaagacagtctgttaaacagactgtctaagatgttgttacatcacaccatactcagctgcggttcaaataattcatagtgaatggattccggcgttatattgaattcagaaatcagctttttcatttctttaatgaacgacggggatccgcacaggtaaaaatcagcatctttatctgtcatcacttcttctaacagctgtttgtcaatccggccttcccgaaaacgaatgttttctgaacggtcttgttcggacggttcgctgtaaataaagacggtgtcagcggatgagtgttccgcggcttcttcagcttcatgccgcagcgcatgatactctccgctccttgccgcatggataaagagaacgtttcgctgcggctgggttttggcaaccgtctttaacatgctgatcatcggggtaattccgacaccggcactgatgagaaccagattctttttggaatcagggtctaatacgaaatccccggccggagcgctgatctcaattgaatccttttcgtgtaattggtcatgcagatatgaagaaacaattccgtcttttttcacggaaatccggtaataatccttaccggatacatccgacaaactgtactggcggatatgcgtataacccgtgtccggaatgtatacttttacactgatatactgtcccgctttgaattcggggagaacttgtccgtcttccggttttaaataaaacgacgttatctctttgctttcttttacctttttatcaattttaaacgccttatcgtctttccagccgcctttttgcgtttccgcttgtttatacatgtccttctcaattccgataaaagcgtctgcaatgacgccgtatgctttttcccatgcctgaatgacctcaggagcagccccgtcttttagcacatcctttatcgcgattaacaagtactttccaacgattggataatgctcgggcttaacaccgatactccggtgcttatggctgatttgtttaacgacggggactatgttttccagccggtcaatattggctgcggccgcaatcacagcattcgacaaggccgtacgctgtgtttttttcttttgattcgtctgattaaagatattcagcagctcagggtgatgctgaaaaagcaggtcataaaatcggcctgtgatttcttcaccatgctcttctaagaccggcactgtgcttttaatgatttcaatcgttttttcatcgagcattctgaaatccccctaaagatgtatgcatctcgattgacctgagaaaagaatcgtttttgaattcttttttatagatttccccgttcaaaaagggttagccattccaatttgagacggattcaggaaaaaccagaaaaacgaaattacagctggaaaattgtggactttccatagtgtacttgtccgatgcaaaatcctccttttcagcatttaataaagtacgggaggtgagatgaatgggtaaaaaatcgaaagtgtattactgtgaccctaagtatattgtgactgacaagtatactgacaaagaagtggtttacgtccatcccatcaaacacattaacagagaacatatccgttatgttccccgccacgtttatcaggaagaaacaattcacgaagtcattgatccgggcgatccggggaaatgcgggtgtaaaaaggataaaaaaagacgcaaaaagtaattggttcgatttcttgcctcagcagacctccgtaccttttggctcctctttttcagaggggtcttttttcatgccgtatcttcaagcaaatacgttgtgaggcggcaatccgcctgatattcttgtcatatacaaattcacaggaggcatgatgatgagcaaaaaaatcgcagttctgatgacagatcaatttgaggatattgaatatacaagcccggcggaagcatttaaagaagcgggccacagtgtggtgacaatagatttagaagcagggaaagaagtgacgggcaagcacggtgagaaagtaaagatcgatcaagcgatctcagacgcagaccccaaggaattcgatgcgttattgattcccggaggcttttcaccagatcttctgcggggagatgaccgcccgggtgaattcactaaatcattcgtggaaaatcagaaacccgttttcgcgatctgccacggcccgcagctgctgattgataccgaccttcttaaaggaaaagatatcacgggattccgcagcatccgcaaagacttaatcaatgccggcgcacattataaagatgaagaagtcgtcgtgagccataacatcgtaacgagcagaacgcctgacgatttggaagcctttaatcgtgaatcattgaacctgctgaaataagcgaataaaaatgcacagacccgttcagtctgtgcatttttttatggattgataaagaaacaccaatagttagacctattctcttccccatccataataagtaaaataaagagtgggtttttcaacactcgacgggaggttcacttatgtggatgatcattttgctgctgatcattttaatcggttttaccggtaatatcatttcgcttttgagagcgcaaaaacacgcatctcaaagaataattgagcttttagaaaagcaaggccgaaaataatcatgcagcgctgtgttacccgtaatagtaataataattccggcagatttcctgaaaaatgatttgatgccctttctcgttcggatgaagaccttctgacatgcacatgctgcggaaagcgggattatacgggtcgatgagatctgtatcaaacaggtcggcatacggtacagagaggagtgtgcaggcttctttttgggctttcacatagtcagccagcttcaggcccagtttatttttatcagtatcacggcggacgatttttccttttgatatttttgcttgtctcgttggggtcaccacaatgatgctcgcgcctttatttccgcttcgcagctgctgaatcacttgacagaagcctccgtaaaatgtggtgatatccttttcatctgtgccgatgggaatgtggttgcaccaatcatcatctgttccctggacaatgatgacatcatgtccctttgttttaagcgcttgctgataaatgttatcgcttccgttgttgctcatattaacgccgctgacagacagattggttatttcagcgtctgtccggtctttcagaatgtcaccaaagccgtattccgcgcgcagcccccgggcgacgctgtcacctaagatcgcgatttttgaagccttccgcagcctgcttatgctgatgaagtcaatgctgatatgcccgctgtccgtgatatgcaaaagcttgctgcttatgttttgcgaagagactgtctttccttcagagttataaaattcctcattcagcttcattcggcgtcatcccttcctttttatcctccggcatcttttttgacataaaaaacggacacgaacaaacagcgccatgttgtcagttcagtgtccgcagatgatgataccggatcttttatgcagttctcttgccattatagcagatctccattacttgtaatagagtctgcttcagcatttaaaacagcgcttgcgggtacgtttttgatgtgaccgtctgctgcgggaacggtgtgt

SEQ ID NO: 114 - DNA, 129210 bp, Bacillus velezensis FL50S
ttgttacgcgcgaaacaaaaatatgaaagagggctgatgaaatgaaaacacaggctgccattatcgggggaggtccggtcgggcttatgcttgcatcagaactggcgctggccggagtgaaaacgactgtcattgaacgattgaagaagacggtgccgtattccaaagcgcttatcatgcatccgcgcacacttgagctttttgccatgagaggcatattggaacgcttcttggaaaaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggagcggggagcattgtccggaaacaggcgggcatcgctttttcgggcactgatgccgacttaacaggaaccctttgtgatgccgctttgaaacatccgcccgaatcttcctttttttcaacgtgccggctggagggatcggttgtgattatccctcttacggacggacttttccgcgtcctcatcgtttctccgcacgtcccgcaaaagcggaaggaagagcgggtcaccgaagatgagctgaaagaagacctgcggcggatatgcggcactgatttcggattgagtgatccggtatggatgtcgcggttcggcaatgccgagcgtcaggctgagcagtaccgctccggccggatttttgtggccggggatgcggcgcacattcattttcccgcaggcggccaaggcctgaatacggggcttcaggatgccgtcaatctcggctggaagctggcggcgcaaatgaagggaaaagcggcgcctcatcttctggacagctatcatcaggaaaggcacagcacaggaaaagaagtgctgcacaatatcaaaacgcagataaagctcatggattttaccgagtcggggatggcattaagagaaacgatgactgctttgctggattttcaggagtccaaccgtttattggcgggaaaagtatccgcgcttgatctgcattatgaaccggatgcggagctgccgccgcataccctgaacggaaaacgcctgccggatatcgaactgacccttcatgacgggcggccggcccggctgtatgattttctccgcaagggcggctttgtgcttctgtcattaagagggagcattcccgccggtattgatacggacagcgtggcggcagtcagggcggagcttgctgaaacacgtgccgattggaatgacgtccacaccgttttaatccggccggacggccatgcggcatgggcagccggcggctcgggacgtgaagcggaagaagccgttctggccggtttggagagatggggattattcatctgataacctttttatgcgcctgtgtgattgtttcttatgtaacaaaacgttatagtaaaagaaacaatcaatacggaagggtgactcagcagttggacagaagacagccagaccatgcaaaacacatgattcttgaagggctgaccgatatttttcacgagcaggagaggtgtcaggaggatatcagggcgtcgttggccggacggatggatgaactccgcgaaggaaacgggaaaaaattacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggctttctgcgcagaacccggctgagtgacaataaaaaagaagtctatttccggctgactcctgccgggaaagagctgcattcccttcatcatgaatatcatgaattgataaaacagcggctcttggcgtttttagaccgctatacagatgaagaactgttatttgctgaacggctgttccgtgatctttcagcaaactggcggtctgtaaatggcggcggagagctgttcaaataaaaaaacacgcatatggatgcgtgtttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtgatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaacccgacggtcagcactctcgtcacaccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcggggaatttcagccgttttgcgcctttacttgcaagccaggcagctaaaataaatccggccgttaataagacgggaataaggcccggatgtgaagctcctgctgaaacggctccggctggtgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgatacccggcatggcggataaaccgcccggcgccgttcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcaatttctggccgagttcgatgccgaggatcatttgtcccgccgcaagccatctgcggtgaatccctcttctgtcaggcgccatgaacagccagcggggcctcgtcatggagaggatgcagccggcggcaagcgttccgagcatccaggcgatcgacatccctgtaagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacacaaaaaaagctccggagatgggtgagtgcaccctactccgaaacctcgcccgcttttcctttccacacaagcgtcaatcccagaccgagaaataaaaccacacctgcgaacagaaacgggaagtgaatatttatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaaaatgatgcaggtgacagcgagcacgggcaaaaaccctgacatcaccgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcgtacgccgacagcccgaatgccaaaacaaaaacgatgataaaggcgatcaagtagcttggatgaatcgactttttcaaatcttttaagaaggttgattctttggcgctttccatctgctttgcgcgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacggcgggcatgataaaagcggcactgatgccccccagcacccttgcgaaatataaaatagagacatgtgtgcccaatccgaaggtcagctcggataatgcgaacaaaaacagtccggcgagaatcatgatttttctgccgaagcggtcaacccatctccccgcaatgggggatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattcagtttatcagcgttgatcgacccgtgaataaacacggagatggcttctttttgcaattcgattctttgctgaatggtatcgtttttatataacacatctaaaccgtagaagacggatagcaggatttttacttttgattcgacatgatgaatggaccagcttccgtcttgatttccttcttctaagatctctctcatcacatcgtcatattcaatatcaattttgttgagccgctttacgacctcctctgacgtaaacgcactcgcataaaactcttcacttgctctcataagcgggtaattgatgctcatccggctcagcagctccgcaaagcccgtcagcttttcggcagcatctttcagatcagcttccatttccctccacgtctcgatcatcacacggtgatcctcttccatgatatgaagaaacagaaactcttttcctttaaaatggtgataaagattgcctttactgatctcggccgcctctaaaatatcccgaatcgatgtttctgaatatcctttttttgcaaataagtcacgcgaagcggatacgagcctgttcttcgtcttttcgctctttccggcaccgccttttgtatttgtcacttcacacagatcctttccgcctcattcatatcgttgtcccggcaaagcggggctcggttcgtttaaaaccgaccagttggtttattttattataaagggtttttgctgactatacaatgaagaagttatccattgtttagtggaagtataaaaacggctcgaaaaataaaccccattctctcctgttgaaagaacggggtttgccgtctatgactcccagcggggagcgtctgaaacgttattttccggtatttacctcggtgtagcttgtgttcggcgagtttgataccgttccccctgtatggtggaaaggagagtgggccatatcgtataaaaaccagacggcatgacgctgctcgtcaaatgccgtgcgggcaaataaccgtttcgcttccggatgcaccgctctatcggatgcctgtaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacgacgtcttccggtttgaggtttctcttatccaattcttctctcagccatttttccgatacgtggttttcttccagatttttcatcaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtatagcgcatctttttcatattatgctcaagtatttttccgttttgaatgataatggtcggtttgcctgcaaagaaacccctggcagttctgtttttcatagaaagatatgcgacaagataaatgataaccacaaaaatcgtgtaagcactgacagtaaaatgaatcggcagttttgtattaaacgacagattggctgtgatggcgccgagcgagatggccgcaatgaaatcaaaaagcgtcatctgtgaaatggtttgttttccgagtatacgggcgccgataaacagaatgctgaacgacagaatcgttcgcacaatcacttcgggatattctgacatcatatttaatcctttttttctttaatttggtcaaaaacgatatgttttaaaacagtcatcccgtttttaccagcagatgagattggtcattttcgtcaactttcgataaaatgtagaaagataaaaagagaggggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggcggcatgatacgcgctcaagtgttcagtttttcgcgtttggcgtggcgcgtgcttcagcataccgggggcatgaaccgtccgtttgtgacgacgacgggtgtgcagatgcttttaaggaaactgattgaagaacataagcacgattttaaagtgtatcaaaaagcgagtgacaaagccggattcactgagcaggtggaacggatgctgacagagtttaagcgatactgtattgagcctgaagacgtccgccgcatggcggaaagcggaacggcgtcagagtatcgcggagagcggatgctgtctgaaaaacttcatgacttaggcattttatatcagcagatggaaagaagcctcgccggacactatttgcattcggaggattatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgcatagagtcgcagtacgatgtgcgccccgccgcggcgtataccggcggacaggaagcttttaccgtcatgcaggcgcaaaacagaagagctgagctcgaaggtattgcccgggaaattcaatcacttgtccgggacggaggataccggtacaaagatatggcgattctcatccgtcagccggaagattataaagatttgctgaaggaagtgtttgccgattacgggcttccttattttatggacggaaaagcttctatgcagcatcacccgcttattgaattcatccgttcaagcctggatgtcgtgaaggggaactggagatatgaagcggtgttccgctgtacgaaaaccgaactgttattcccgcttgatcagccggagcagaaaataagagagcaggtagatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttatccggctgcagaaccggatgaaaaaagcgaaaacggttcaaagcatggcggaggctctttatctctttttggaagataccgatgttcccctgaagctggaccggaaaaggcagcgtgccgaagaggccggaaacatgatcgaagcgcagcagcacggccaggcgtgggatgccgttatccagcttctcgaggagtttgccggcatgatgggtgaagatgaaatatctttggcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcggtcggagtggagctgtcttccgcggggcgtgagcggctgcttgatgagcattttctcatctatatggcgctgtcgagtccgtctgaccgtctttatgtgtcatacccgattgctgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccagcgtgcgaaaaagctgttttcaagcctgtttttccgcaatgaggcgaagcgtcttgaacggcctgtttcgcgccagctttacggcgagcatattaaaggaagcgtctcccggatggaggcgtttaatgcctgccagttttctcattttgcatctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttttacgtgaaggaaaaactgcagaagatcgtcacgcgtgtttctggcatattaagcgagcatgcgaaggcgagcggtttcgtcccggtcggtcttgaactcggtttcggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgatagggggcttgatctggctgaggtgtattacgggctcgctctgcaaatgctcacatatcttgacttatcgattacacattctgcggattggctcggcatgaaagcgaccccggcaggcgttttgtatttccatatccatgatccgatgattcaggccagtctgccgatggggcttgatgaaatcgagcaggaaattttcaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccacgtgcggcggacatttgaacaggcgggcgaagcgataacggacgggcttgtgtccattaccccgtataagctgaaagataagacgccttgtacgtactgtgcgtttaaatcggtttgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttccggccgcgatattcttgtcgctgccgcagccggatcaggtaaaacggccgtgctcgtggaacggatgatcagaaagataaccgcggaggaagatcctgttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaatcgggcgagcatttcgacgcttcactctttttgtttgcaagtgcttaaaaaatattattatatgattgatcttgaccccggttttcggatggctgaccagacggaaggcgaattgctcggagacgaagtgcttgatgagctgtttgaagatgaatacgcaaaagggaatcaggcgttttttgagcttgcggacagatatacgacagacaggcatgatctggatcttcaagaccttgtcaaacgggtgtacgagtattcccggtcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtaattttctggatgacctccagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggaatctatcctgcagcttgtgaaaagcggggatgaacaggcgggaaatctgtttatggtaggcgacgtcaaacaatcgatctaccgtttcagacttgctgagccgctgctgtttctcgggaaatataaaaggtttacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcagacagctccgaggatgccgaagactttgaaaccgtgcattgggaagcgaaagcgatagccggggagatccgaaagcttgtctcatctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcctgtatgaccgggcgcgctcgtacgaagcgacggcgttccgcgggttattccgctttttgcggtttattgaacggatgcaggagcgcggcgatgatctggggaccgcccgtgcgctcagcgagcaggaggatgtcgttcggctgatgacgatccacagcagcaaaggacttgaatttcccgtcgttttcaccgccggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcctatccgaagaattgcgcgtattgtatgtggcgctgaccagagcgaaggaaaagctgtttctcgtcggttcctgcaaaaaccgggaaaaacagctggccaaatggcaggcgcaagcagaccgggccgattggcttctttctgaattcgaccgctatcaggcgtcatcttatttggactttatcgggccggcgctcatccgccaccgtgacatggaggcgcacaggacgccgggactttcttcgactgaggatatcgcgcgcgacccgtcgcgttttcacatccggatgctgcagcaaagtgaattgctggaagagaatccaaaagaacgtgctgaagaaaagagcaaacgtctcaaggcgatacagcagggcgagccgattcctggttcgttttcatttgatgatcaggcgcgccgtctgcttgaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacattccgactgccgaagaagcagagcggacggtccggatgctttacgaaaaagagctgctgacagaagagcagcaggaagccattgatatagaagaaattgtccggtttttcggaactgaaatcggtaaagatcttctcggggcgctgcggattgaccgggaagtgccgttcagtatggcgcttccggccggcgaggtgtacaaggatgccgaaacggccggtgaaccgctgctcgtacaagggattattgactgcctctacgaaactgcggacggtctctatttgctggactataaaacagatcggatagaggggaaattccggaatggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcgggggatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcgggctgtgccggaacgatgccgtgaaaatcgcggcgagccacatttatgtcacggggggaaatcagaccgattcagagcgtccgattgaagtcgggggcgcttacacggtcgccgctgacagcctgccggctgatgcggcttacgtggctctcggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttccctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgtgctgccgcaaggaaagtttgccgagtttctgtcgcttaaaggtgcggaaagaagacatatgctccagcgtctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagcttgaggaaagacgcccgtacatcacggatttgactgagcgtcttaaagaggcggaaacagctctcgcccttgagccgtacgcagaccgctgcaccgaagccgtccgccggaagcagcgcgccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagtcattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgccgatgaacggaaaaaatgccagaccgcagcacagctggcggcgggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgaaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcgcaagactgattagcgcgcatcagcagacggtaaaacaagctgagcagcttgccgaacgaatccgctacgaggaaaaagaagccgaccgtctcagacattcattagaagagcttgaatcgctgtcagaaagccgattgaatcagtacaacgaagtctgcggtgatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggcttgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcgctgaatgacgcaaaaggccgggaatcagggagtctcatgtcactcagggatgctgaggcctcccttgagaaagcgcaaaacgactggcgcgtgaggtcaaaaggcaccgggtttaccgagccggaccaagtcaaaaaaagtctgcttccgcaagggcgtgcagaggaaatgaaaaaagaaattgatgagtttctggacacctcaaaacagctatcggcaaatatcagccgtgttactgataaattagccgagcgccggatatcggaggaagaatggacagcatccgtttctctgctgaagcaggcagaggctgagtcaggcgccgccatggaggaaaaaggagcacaggcaaaagcctacgcggttatgcaaaaacagcataagcgctttaaagagattgaagccgaactgaaaaactggcagacacagattgacaggcttgataagctccagtctgtatgtaaaggcaatacattcgtcgaattcttagcggaagaacagctggaaagcgtggctcgagacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgcttgccttgtccgcccaaattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggtacatgtgaattatgcggccgccatcatgtgcggctgacggagcaccacttaacgcctaaggaagaaggcgggacattccttccgaccgcaatgctctgcatcccttgtcataaacaggttcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgaccgacgtcgatccgatttgaaccacggacgctgacgataccccttgaactttcacattccttacccgaattgaaggattttcatggcagaatgcgctttggactcctgtttccggtaacggcatgacggccggctgccgaaagatctggtattcttttttgttaaatgagccttcatcatctctgtatacagcaagactgcgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccggtagaccggatgtcgccgacttcaatattccggttaatcactgtaaaaatcatgacggatcatcacctttcatttcaccaggtatgtgtttaataaagtgctcgacggccctgacaatatcacgcttcacatgttcggcaatctgctcggcataatgcgcgggcgccgtattttcttctttcgggacatgggacagataatactgaatccggctgtccatctgctttctgatatcttcaataatatgatatttgttcgtttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagttggattcaatccgatattcagcgttccttccagccgttcaattttcagctgatcaaatttatactcgagccgatcgattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtattgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgcctatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcactttacagatgccgggtcttatacataaatgatacagatttatatacatatcacgtttatgagaaagcctcttttctttcgcggccgtgctgaatctgtgcggccgggttcggcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgcccggaggaagaatacataaaggaatgccatttaaaaatgatgggggattaacatgaaatttgcgacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagtttgtcgcgcatgccggacagcttgcggaatgggcgaaaaaaccgaatgacgagtcgggttcatttatgtatgcgctgtctgacgtaaagctttgcgcgcctattccgagaccttcaaagaacgtgatctgcatcgggaaaaattatcgtgatcatgccgttgaaatggggagtgaggcggatataccggagcatcccatggtttttacgaaagccccggctgccgttacaggacacggagaaacagtgaacagccacttggacgtaacggagcagcttgattatgaaggggagcttgcggtaatcatatcaaaaagcggatcgcacatctccaaagaacatgcgcttgatcatatattcggctatacaattgtaaatgatataactgcgcgcgatctgcagaaaaaacataaacagttttttatcggcaaaagcctcgatacgacatgcccgatgggcccggtcattgtacataagtcggccgtcagtgatccgcaaagcctgaaagttgaaacgcgggtgaacggagaactgcgccaatcaggatcaacgggtgacatgatttttccgatagctgaattaatcgagacgctgtcaaaagggatgacgcttgaagccggtgacattatagcgacgggaacgccgtccggtgtcggaaaagggtttaagccgccgaaatttttaaagccgggggaccgcattgacattacaattgaaccgatcggcacgctgtcgaaccaaatcggataattgtgtgtctttcgcacgattgataatgctccgagcggcttgttgtggtaccataagtgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgccggaaaaatgctgctcggcatcattaccatcggactgatggaaatgctcgtcatccgcaagaaaaaaggcaaatcaaccggcggactgtggatcggttttattatcgtgctcgtcctgacggtgctgctcggccttcacttgccgatcggttttcacgtattttaatcaatcgcttgaaaaacccggatgcatccgggttttttttagttgcgcaactgggccgctgaatgagaaatgccgtgttgatgaggcgaaagagatgtgcaggatgccaaaagcgtcaatcactcttgttgccgcaaaagctacggctgtgatgggtaaaagcaaacgccggccgtcaatcagcgtgaaaaacaaagctgaatacatcaggcggcacctatttaaaaggtgccgcctgtttgttacgcggtgccgtcttgtcttgccgctgaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattataggaaaatacgcaatcatatacagacaggccgaacccgtgcagatggctgagaaacagcagaaacgtttcatcgtccagcgaatcgagcaaggttaacagcggccgtttgaccgccttttcataacggatttcttccccgccgagcagggggatggtgtctgcgccgatttcggccgaaccgccgcaaatccgtgccggctgccatctgccgtcgcgtttcatcaatacgtctgcgtttccgagactgtctgcaagcaggatatcgccttcatcgttttcgacgaggcagatgccgtcctctatcatcagtgtgccgcgcccccatttgtttttttctgagaaaagctgttttcgtttcataaccgtgcccgtctcctttgtttgtttcttctcttccgttctttccaaatcgggcttgtctcatacaactcttagtgggacaaatcaactatctgcgtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgaaagcggctcttcggggcaagagaccggctcggcgtcaagccgtttttttataaagaacacggctcttcctttctgtttgggtcggaattgaaagccattcttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgattcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataagtgcgtgattacgcaggatcagctggttgaacatctggaggaatccgttctcgtcagagacctgccgggcatggctgatgttgattcatcgctattatggttctgccgggaaattaaaaaagattttgtcgtgagcctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgacaaatctgctcgaccgcaaagaccgcatgagcatgggcgcaagtcttgaagtacgggtgccgttcgccgaccacaggcttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggtcacagaatggctgaaaacgattttacaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatacgaaacatgcgcccatcttgccgaggtgcactttcctttatataaacggactttctcattcctgccgccaaaaaacaggcgggccgcatgggcggtgcttgctttgtttcacgaagctgatcggcttgatatgcaggaacttgggggatttgaacaggcggcacaagactttctgaacggggcacgcgccgacggctttttgtgggaggcgctcactgatgtgcggcagcaatttgcgcttgaagaagagccgttgcgtgagtttatcgccggccacatctctgacagagaaaaagtaacgtatcaagagtttgatgacctgctgatgtacgcgggccaaacaggcggagccctcggcctgcttctgctgccggtttgcgcgcgccggaaccaagagaaactccgccatgcagccgtttcattaggagcagccattcagctgacccgggtgcttctgagggtccatacggatgagcggtcgaaaaagcgtctcccgcgccaggtgatgatgcaattcggctatacggaagaagagctggagagccataccgtcaacaaagcttttatgaatgtatgggagtacatcgcattcgaggccgaggcgtatttcgaggaggcgtctgaagagctggagctgtttccgttatactcaagacccgccgttaccggtttgctggcacattaccggtcagagctcggtgacatgagaaaacggctttcgcaagcataaaaaaacgcccggcttcttaacgaagctcggggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcagggctgcttgtgaaaattccgatcagctgctttgaaaacaaggtcatgatcaccgatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttgtaagacagctgttcgccggcagacggaatcccgattttcaggagtttccgcaagtgctctttatggacgtgaaaaatcttttgccatgtcagaccgagtccgatgcgttttttgacgatcacaatcatcgcgatgagcccgatgatccgcgcaaaggacgttgacatcgcaacaccggcgacgcctaacaccggaaggccgagcggcccgaaaatgacaagaaagtttccgccaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaatatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatatattctgctttctcccgggcttgaacattacggaacaaaaggcagtgaagaaacgacatcctattcgtggcttcattttgaaggagcggattatgaggtgacggaaaccaccgggaacaactggtcggagctgaggcgaaaaaaagggagctttgaagagccgtcccgctaccgcttgtccctgccgcaaaaagggaaggtgagacgcccgcagtttatggccgggcaattcagtgtgctgacagatgacagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggctcttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatggtgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgcgggtgtacttgggtttcatatcattatctgcagcaccgattatcagcctgaaaaagaaacgaagtatttttcgatgctgcggcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggctcgaccacgggtgaaagagacagaatcaaaggttttcaaaaagcgctgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgtgcggcgatacaggcggcgcgctcccggggcattcgggtgccggaagacttgtccgtcatcggctttgacaataccattctcgctgaaatgacggcaccgccgctcacgacgatttctcagccgatccgcgaaatggggcggcgtgtcgttgaacttctcattgatgagattcaagggaagaaaaaaacaaaaagcaaaatcattttatctccggaactcgtcatcaggcattctacggcaccggtaaaaacgcgccctcagcgataaggcgcgtttttttctgtgaaaaacattgtcaaacgagcgaaaagcattgtaaaattaaaacagcttttgagaaagcgcttgcgcaaatactgcggattgcaagcaaagaaagcaaacagcttgagttgtaaataaagcgctttcaaaataatgatttctgtttaataagagaaaccgcttgcgccattacggcatgcggcctcaagaaaaaaggagcggtgatagatgacagatcaagtcaggtgtgcggtgctgggattaggacgattagggtattttcatgcgaagcatttagccggcgaagtgcggggagccgagcttgcggccgtctgtgacccgatgaaggggaaggcggaagcgtgtgcgaaagaattaggaatcgccaaatggacggagaatccgtatgaactgctggaagatctcacgattgacgccgtcatcattgtcacgccgacaagcacacatgcggaaatgatcatgaaggcggctgaaaacggcaagcacatctttgttgaaaagccgctcaccctgagtcttgaggaatcgataaaagtcatgaaaaaaatcgaagaaacggacgtcatctgccaggtcggttttatgaggcggtttgatccggcatacgccgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcgagatatctcatgaatgccgaggttacgtctgtcagcgggcacgggaggattttaaagcacccgttcatggaggagtgcggcgatgtcgatcaggcattaacatatcttgagtttgattcgggcgcggccggcgatgtggaggcaagccgaaattctccgtacggccatgacatccgcgcggaaattatcgggacggagggaagcattttagtcggcacgctgcggaaaagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttaaaaatcgggatcgccgcgacggaatcttttaaaaccggaaggcctgtaaagcttaccccgggcgcccccggctatgccggattatgatagattcgaagtaaaaaagcaaaggcccggcatgcctttgcttttttataattcatatgagaaaaaaatgtagtcagtcggcacgcctttatagcccatttggtgaagcatcgcgcttatattgccgcgatggtatgtgccgtgattcacaatatgccggatcacatcggcatatgtcgtccgaagcgttcccatgcgcggatgagaaatggagatcgggccttccatgttctccgattctcttaaaaattcgctgtattctttgtccagttcagtcattctatgttcaatcgcctcaaaatctccgtcaagcttttcaaattgatcaaactgcgagacgatttgttcgtaagtttctctgtaaagcacgtgaagccaagtgtaatcagcccggcatatatgcacaagcacggcgttcaaagtcggaaaaacactatccagttcctgctgtaagcttgccgcgggcagggtcttcagatgctgaataacttgctcattggcccatctatggtagtgatacagctttaaaatgtctgacattccaattccccctcttccttccggtacattcaacatgacctggccgaattccttttatcgaaacaaaagcgccgcaaaataaaaagcagcaccccacatcaccaatgccgagcattgattcaggatgccggggagccggccgcctgtatccgcggtttcgtttaataaaaaatcacgtcacgatggcgccgagcgcttctgcgaatgtaacggcatgagacggagagatgcggcatcctttcagcttatcaagcgagacgtgcagatgatcaaatgtgcacgtgctgatatccatattaaaaagagacgtgccgatgaagtttgcgccgttcaaatcacagacgtcaagatctgtgtattcaagaacagcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagacatccgtaaaaacggtgtttctgaaaatgactttttcggcgcgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgttttcgcccctgcccacccttgccgaattgcgtgttgtttactgaacaaaggttaatatcaaagcgggatcgcgtcaatagcggcgcttataaaagcttcattccgtttgaacgtcatccggcacgccgaaagataacaaaacaaagcccttataagagatgccacgggcttttgtctgtttcaggcgagttctttatacatgatcacatgcgggccgatgccgggtatgtcaaaggggctgcccgtgcttttccagccgagcttttcgtaatatcccttcacgtgacatctggcgttgcaccagacaagcgccgcccccatatctgccagttttcgttccgcataggcgattaacgtgcttcccgctttttgcgtccggtattcttcaagcgttgccatgccgcgcagctggtaggcgggcgccgcctgtaaagcctgctggttcttcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccatgaaaaaatcctcctttgcttgattctttttctgtatcgtaccatgaaaaagccgcctgtcgtatcaggcggcatcttccgcgtcaatgcaaatatacatcagcccgcttttcatccttttgcttaatataagctgcaagttctgatgtcaaatcagaacggagaaacggggtgattaaataaattccgttaaacagttcgcacgccgtgtcgagaagcgacttggcgatggcgaggccttcggctttctgcttttgcttgtcttcgccggcgagcgccattttttcccggatgctgtctgacagcttaatgcccgggatttcatgatgaataaactctgcgttgcggctgctcgttaacggcataattccgatatacaccggtgttttgagatgtttcgtttcatgatgaatgtcaatgagctgctgctccgagtagacaggctgggacacgaagtagtcagctccgcactcgatttttttctccagccgttttaccgctttatcaagatggcggacattcggattaaatgctccggctacggaaaagttcgttttcttgccgagcggtttccctgataaagaaatgccctcgttgaattgtttaatcagcctgatcaagtcaaaggacgttaaatcatagacggaggtagcccccggaaagtcgccgatttttgaaggatcacccgtgatggctaaaatgtcggtgagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagtcgccgcttgcagaaatttgtcaaaattcaattttttcggcggatcaagctctacgataattgaccgtttttgagcggcgatttcgtttaaacccggctcggtccgttcattccggacggagatgacttcttcttcccgtctgattttcacttctttatcagtgacgggggaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagccggccttcttctaaagacgggaggctgctgttcggatagaccgataaataagtgtcacggaatatcggcacttcggtgagcgcttcaatcatgtggtacgggccgagccggcaattgattcccgttatgtcagcgccgagatcggcaattgacctgagggcttcccgaagcggcgttccgtcctgcagcacgccctgttcgtgcatggatacattcagcataatcggaagttccgtttcttttctcgctatcttcagcacttcgcgcgcctcttctaaatcatagtatgtttccaggagcagaccgtccggctcttcgtgaagcaataaataaagctgctcccgaaagctgcgtttaatctcctccaggctgtaggcgtttttgttaaatgtgcggatgccgcccatcgttcccaatacataagcgccgtctgaggaagcgcgcgcgattctgaccgcctcctgattgatttttttcgtttcatcctcaagtccgtatcttgagagcttaataaaattcgcgccgtacgtatttgtctggatgatgtctgccccggcttccacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactctgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatgtaattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgcgactttaccttcaagccggagtttttaatcaccgcgttgatttttttggcgctgtctttatcaatgccctgtacaagcttcgcgcgctggcgcaccgtgccccctgaggcattttcgattttgccgtattcaatgttttttgtcggcacgtcccgtttgatcagcttgccgctcagcacatctttgagctgattcagtttaaactcgtcatcagaaatcaggacaagttcttccttttctaaagttacatcgcttttagatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaaccgacggcgaggatacggttcttttacataacagtgaaattacagaggatattgaagacagagatgaagtggacgtatttatttacgtcgatcatcaggaaagactcgcggcgacgatgaaaaagccgctcatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgtcatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagcttctatgccctcatttgtttatcaccctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgagggggcggcggctgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcagacctggataatgtcacctccgtcacgtttaaagaggatgaaggaagcttcttagccggagcgctcgcggctatgacgagcaaaaccggcacgatcggatttatcggcggttcagatgccgacgtcattaaacggtttaagaaaggctatctgaaaggcgcggaatcagtcaaaccgaacatccgcgtgctgtcggaaatcagcggtacgtttgatgatgataagctcgggaagcgcatcgcccaaaacatgatccgaagaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacgcgctgttaaacgtccaggaagcaaaagccgaccttaatacgttaaaagaaagcatcaccggttattcctatacgctcgcagacgcccagagagaagatgtacgaagctatatgaaaagcagctcagacaaactggcggcgctcaaaaaaacgatgacggacgatgcggacaaagccgcttatgacaaactcgccaaaaaatacgaatcgtggcaggcggaggcggacgctgctcttgattcgaaaagcccggctgaagcgacaaggacggcggcccgcatcaacggtcttctgaatgatatttatacgctgaatctgaaaagccgggatcactatgaagacatgcagaagcagacggctgaccagattcagtttatcgtttacagcgcagccgtgctgaccatcgtgatacttgctgtcaccgtcatatcttccatcaggctgacgaagagaattgcagggccgatccgccgcatggctgaaaatgcccgtcgtattgcagcggggaaccttgccgttgaaatgcttgattataaagggaaggacgaactgaaagagctgaatgactcattcggaatgatggctgaacagctccgcaccttaattcaggcgatcggagaggtcggccgtgaagtcgagacttttgcggaaggtttgacgaaggaaaaccagacgctgaaggacatgaccgagcaggtgtccgtatcgacggaagaaatggcgcaaggctcccaaaccatttcagaagatctgcagcatgcggtgcaattcattgaacaaatggatgaacattcaaaggcgaacgccgaacgttccaaacaaacgacgagaagcagcgaagagacgattgcggcggtggctgcggggcgaggtgctttagccgagaccaagcaagccattgataaaagcaatgagacatcaaaagagatttccgaagccgccgatctcttcatagagcatgcggcaggcatcagtatgatggcgcagaccgtttccgacattgcgggccagaccaatctgctgtcattaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtactgcatcatgccgaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaacgatcaggtccgccggtttactttgtaacagacatccgtgcgcaaaaaacagccctctttctcctaagacaagagggctgttttccttttacagatggtccggttttttggaattctggttttttcccgcctgccggtttttttcggcaagccggttctttttctgatttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatctttttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgcgcgagataggcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccagtgaagcgcatttggaatctacaatccgtaaatcaaaatcgggaaattcctcttttacttcattggcgatcattacggccgtctgataggtgccggaaagacctgaggaaaaggagatgtatatcgccggttctcccagttccgcgtattgtaaaaatactttttttatcgtatccggtgatgcctgggatgttttcggaactttcccgtcccgcatcgcttgaaagatatgatccgcctgaatggtgaccgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtgatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcgaatgtatatgccagcggttttaccggtgtcgcccagctgctgtcaagcgtcgttgatcaatacgcccccttttatatttcgacaggagttctcatgttcctcttaaacattcccatcggtgtgttagggtggctgaaagtcggcagatcattcaccgtatacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacatcacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacgtttttagggaagtccgatcagatcggaaaaagactgaaaacggtaaaaacatttgaagtaaaataaaaaagcggcgccctcatctcaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcataacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaaatcggcgattccgtccgcttcatttgaacccgtgacgcgatcggcggcctgtttgacttcatccgtgccgttttccatcgctacgccgcacccggcaaatcgaagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcggataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgataatggaagtacacatcatcaatgatctcagcgagcacattatgtatttggtaggtctctgtaagttcggcaagctgtctgaccacatcgacagataaagacgtgtggtatcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaaccgtatcaggcattccgtttttacatattgtaaaagaagaaaatcgggaccgtcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagcgcgcggtctgattgaagacgggcggatcggtcttgcggggacgtcaatgggcggaattacgacattcggcgcgatggccgcgtatgattgggtcaaagccggcgtcagtctgatgggaagtccgaactatacggcattttttcagcagcagattgaccacattcaaaagaaggacatcgacattgacgtcacaaaagaacaggtcgatgaactgtttgcgcggctcaaaccgttcgatctcagtctggaaccggaaaaactccgcagccgcccgctgctgttctggcacggcgttcaagacaaagtcgttccgtatgcaccgacccgcggcttttatgaaacgattaaacctcattacagcagccggcccgaccatcttcagtttctgaaagacgaacgggctgatcataaagtcccgagatacgccgttttagaaaccgtcgcctggttcgataagcatttataaagcacaaaggtgttaacaaaagccgcttttgcgttatactgaggaaaaaggagtgatggaacgtggaagaagcattaaaagaaaacatcatgggcgccttggagcaggttgttgaccctgagctcggcgtcgatatcgtcaatctcggccttgtatacgacgttgatatggatgacgacggcctgacgcacgttacgatgacactgacatcaatggggtgcccgctcgctccgatcatcgtcgacgaggtgaaaaaagcgctcgccgacattccggatgtaaaagagacggaggtccacatcgtctggaatccgccgtggacaagagacaaaatgtcacgctacgcaaaaatcgcattagggattcagtaataagaaaatgcaccccggattttaggtgcatcctaaagtttggaggtgcttttcttttgtctgcatataagcgacagtgagggcttgttttggattgcaaacaaacctttatatataaaatttcatatgaggtttatcttttttgtaataggacagtctgtcttggagtgtacctgtgcggaattcaaatttatgtccatcgggatcagtaaaataaattgacttttgatcttgcttatccctaggacgcccatttaatatatttacatttagattttttaacctttgaagtattgcatcaaaatcttttgggtcaattgtaaaggccgtatgcgtataggatttatgtatttcatttcttggtatatccgcctctaagttaagtgcaagccaaagcccgttcagatcaaaatatgctgttttttgccctttaaccagaagttgtgcatgaaatactttctcataaaattctatagatttttccaaatctgaaacagaaaaaagaagatgattgatcccttttatgttcattttccccacctcatttaacatctttgttttaaacaatccctttggtaatacatctgcatatatatcgattatatactgactaaaaaatcatttttagggatttctgtgtattttttatgcctggtgttttccggatgaccgttttgaactgtactaaacatgattctgccggacgcgtctgctttgtcgctgcagaccggcgtgcggaaagaagggcaagtcactaaaaaaaacaagtttcccgccattcggggttttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtaagccgtctcatgcccgtgaaaattaagcagacggtcaaaggaaaagagaaagaaacattggtcgaaacgattaaggaagcaaagagaaagcatttgaagatctcaatcgcaggcgcccagcactcaatgggcggccagacgtattatgaagacggcatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggcgtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttgcacgatatgtatgtgactgattacacactctcagacaaccagaaagaattaaagcggcacaatgaactgaaagaagatgagcatccggcgctgacgaaattcgcgctcggcctctcccgccggtatgactggggaagaaattggttctggtcaacccagcagtcttattttctcagtcaaaacggcgtgaaagtctccaggaacaatgtcatgcggtcagaatcgaaatttttggaatatgaaaacacggacaacaccgacgtgcttcaagaatacttcgtgcccgtcggcgaatttgcaccgtacattcatgatttacgcaagacgctgtcacatgaagatctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtgcagcgcggattgtcagaaaaatgacggatacggcgttgcgccaccgcggcagctattatctgccgtatatgctgtatcaaacgaaagagcagatgcgcgaggcatatccgaaaagcgatatgttctttcagaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacactcaattcggtctatcatacggcttgttcggcctgagcggcgcattgattcatccgctgctcggccggctgtcggcaagactggatccccgctggttcctgatggcgaattcgtgggggatggcggtgcttcttctgacgctcccgcacattaccggcgtgcaccaggtttatgtggtgcaggtgcttttgggcctgttcggcgccatgcaaaaacacggcgagaaaatcatgatcgccgattacactgacggcggggagcgggggaaaaaagtcggcagctatcatttctggacggccgtattttcagctgccgccattattctcggcgggtttctcgctgatttcttcacggtttatattattttttacgccagctccgtgctgttttttataagcgggctgatgatgctgaaaaaaacaggctgatccgatcagcctgtttttcttatgaaaccccctcgatcgagagggggtttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatgcagaagattgtatattatattcatcgagcgacgaaggaaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggcgatctgcggattcaaaacccggccgtgtatgaaaagtggtataagcggaaggccgcgccgaaaggaacgattcaaagcgcggtttacggtttagccgaactgcaaaaagaagagattcagactgctaagctgattgccaatccgggatgttttccgacggctgtgctgctcgggctcgccccgctggcgaagaataagcttttacaagattcttttctgattgttgatgcgaaaacaggcgtatccggtgccggccgaaaagcatccatgggcactcattattctgagctgaatgataattttaaaatttataaggttaatgagcatcagcatactccggaaattgaacagcaattagcggcttggcagcccggcacaggtccgatcacgttttccgcacatttggcgccgatgacaaggggcattatggcgacgatatatacggaggctccccctggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgaaagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaagtaaaaggcggcgtatcttcgccgaaagggtttgaggcaaagggcgtgcactgcggtctgcgctattcaaaaaaagatctcggagcgattatcagcgaagcgcctgcagtcagtgcggcggtatatacgcaaagccattttcaggcagcgcccttgaaagtgacgcaagagagcttaaaaaaagaggccgtgcttcaggcggttatcgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagacatgaaaaaaattcaggcgggcattgaacagctcggtcaagcgccgtcagtgtccggagcatttgaagaagccattttgacgacggatacagtgacgaaacagacgtgttatgaactggtgatcggcggaaacatcatcacgatcggcggagcggcgaaaggctccggcatgatccaccccaacatggcgacaatgctcggctttgtcacaacggacgcggccgtggaagaacagtcgctcaaaaatgcgctcagagagattacggatgtttcatttaaccaaatcaccgttgacggagaaacatcgacgaatgacatggtgcttgtgatggcgaacggctgcgcggggaatgattgcctgacggagcagcaccctgactggccggcatttaaaaaggggttaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagatgccaactgggggcgcatcatcggcgccatcgggcacagtgcggcaagcgtaacggccgaacaagtggaagttttcctcggcggtcagtgtctgtttaaacacaacgaacctcagccgttttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacatagcaaaggggagcggcatgaagaaaaccatcgtttttaagtgcggcggcagtgtaatccgcgagttatccgccgatttttttcaaagtgtaaaagagcttatgcaatcgggctggaaccttgccgtcgtgcatggaggaggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcgtcttaccttaatcaagacaaatacggagaagtcggcgaaatacaaaaaaccgatccgtcaatcatccacgcattaatgaaagaaggcatcattcccgttatcgctccgctttccatgacaagtgatttcgaaacgctgaacgtcaacgcagacgccgcggcatcggccatcgcttcagccttacacgccgataaacttttatttgtcacagatgtcgaaggaattatggacggagagaacaggctggatactttgtcgccgcaagaaattcaggccctcatcgatgacggcgtaatttcaggggggatgattccgaaggtaaactcggcattatcggcactgagtgaagatgtcgaggaagtgatgatcgtaaacggaaaaggagcgtttttcaccaatcaagtcttccggggaacaaaaatcgtcaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacagaagcggtgaaagaacagcttggcagcgtatggcacgtttccaatctgtttgaaaatgatcttcaggaaaaagccgcggcaaagcttgccggacatagcgcgggggatctcgttttcttctgcaacagcggagccgaagcgaatgaaggcgccattaagcttgcccgtaaagcaacgggaaagacaaaaatcgtaacatttcatcaatcctttcacggacggacctatgcggggatggccgccaccggacaagacaaaatcaagaccggtttcggaccgatgctccaaggctttcactatcttccgtttaatgacccgtcggcattcagcacactttcaaaagaggatgatatcgccgccgtcatgcttgagacggtgcagggagaagggggagtcaatcccgccgatccggaattcatcgaagccttacagacattttgtaaagacaaacaggcgctgcttatcgcagacgagattcaaaccggaatcggccggacgggcaaggcattcggctatgagcacttcggcatctctccggacatcatcactgctgcgaaagggcttggaaacggttttcccgtcggagccgtgatcggcaaaaagaagcttgccgacgcctttacgccgggtacgcatggtacgactttcggcggtaataagctcgccatggcagctgtgaaagcaaccttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgcttccgccgcttacggtttctgaagaagaaatgctgtcggccgtcagtatgctgaaagcagcgatcgaagcgcattcggcagtgaaacggtaatttttttcgatataaaggtataaaaattcatatttttaattaattattcatcaagaggtgggctttagatgaaaggctatttagtattggaagacggaacatcattcggcggtgaacttgaaaaagaggcttgctgtgttggcgaagctgtttttttcaccggaatgacgggctatcaggaagtgcttacagacccgtcatataagggtcagatcatcgtctttacgtatccgctgatcggaaactacggaattaatgaaaaagaccttgaaagtaaaattccacaagtcaaggctgttgccgtctatgaagcgtgtgaacatttttctcaccatgaagcagtctcaagcttgagagagtatttaaataaatggaacatcccgctcttaaccgaagtggacacacgggccgtcgtcaaagccatccgctccggcggcacgatgaacgctgccgtgtcaacagcaggagaaattcccgcagcatccggaacacaaaacccggcggagctggcgcagtctgaagacatcacttcaatggggaacggagaccggcatattgcgctgattgatttcggatataaaaaatcaatcgcctcgtcacttgtaaagcgcggctgtaaagtaacggtcattccgtatcagcagatgaacgccgtttatgacattcagcctgacggaatcgtgctctcaaacggcccgggcgacccgaaagcgattgcgccgtacatgaaccggattacatctttactcagtgatttccctgcactcggcatttgcctcgggcatcagctgattgccctggctttcggaggaaatacgtataagctgccgttcggccacaggggtgccaaccatcccgtcattgaccggaaaacgaaacgggtgtttatgacaagccagaaccacagctatgtcgtcgatgaagcgtcaattgacgaaaacgagctgtccatcagatttcaccatgtcaatgatacatcagtggaagggctcattcataaacgccttcccgtattaagcgtccagttccaccctgaagctcatcccggtccggctgagagcgagtggatatttgatgaatttctagagaaagtgataccagcaaggagagaaatcgctcatgcctaaagatacaaccatttccagcatattagtcatcggctccggccccatcatcatcggccaggcggctgaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcattgaggccattattgaaaaagaaaaacccgacggtctgcttgccaatttgggcggccaaacggcattgaatttagccgttaagcttgaagaagcaggcgtgctgaagaagcatcacgtcaagctcttaggaacatcggtggaaaccattcaaaaaggcgaagaccgggagcagttccgcgccctgatgaaagagctcgaccagcccgttccggaaagcgaaatcgtcgacaacgaagaagacgccctccgcttcgctgagtctatcggatttccggttattctgagaccggcgtacacgttaggcggaaagggaggcggaatcgcgaaaacaaaagaagcgtttcagacgcttattaaacaggcgctgttagcaagtccgatcagccaatgcctcgtcgagaaaagcatcgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcccagacgttaacggatgaagaatatcagatgctgcgttcagcaagcctggcgattatttcggcgctggatgtggtcggcggctgcaacattcaatttgcgctggatccgttcagcaaacagtactatgtcattgaagtgaacccgcgtgtcagccgttcatcggccctcgcgtcaaaagcgactggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacaaagatgaaagcgacgggagaggtcatggcgatcgaaagaaatatggaagcggccattcaaaaagcggcggcctcccttgagctgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattagaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgttctgaccctgcaaaagctgggatatgaaacgattatgatcaataacaatccggaaacagtaagcacggattatgaaatcgccgaccggctttattttgaaccgctgacgacagaacatattttaaacgtggcggaacatgaaaacattgattttgccatcgtccagtttgggggacagaccgcgatcaatgccgctgaaccgctggaaaaagcgggcattccgctgctcggaacatcctttgaaacccttgatgcgctggaggatcgggatctgttttatcagctgcttgacgatcttgacctcaaacatgccaaaggcgaaacggcttattcaaaagaagaagcaacggaaaaagcaagccgaatcggctaccccgtgctgatccgtccgtcttatgtcatcggggggatgggcatgatcatcgttcattcagaagcgcaaatgtcagagctgctgggaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtaaaactggcttttaaaggcattatgaacattcagtttgtcattgatgacaaaggggatattctcgttcttgaagtgaatccccgggcaagccgcacggttcctgtcgtgtctaaggtgatgggggtgccgatgatcccgcttgccgccagattgctggccggcgcttcccttaaagacatcaagcccgaggttcaaaatcagcacggaacggcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatacgttcccggcatgggcagagcgaaaggataaagcggtccatattaatttcaatcactctgaagaagcgcgtaagcaacggatcgaagccatgacgcacggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcgggggaacgggactatttctttcaagcagcgacctgcagcttgggcggggggagacggtcgcggatacggcgaaggtgctgtccggcttcgttgatgccattatgatccgcacctttgagcatgaaaaagtcgaagagcttgccgagcatgctgatattcccgtcataaacgggctgaccgaccggtatcacccgtgtcaggcactcgcggatctgttaacaatacaagaaataaaaggaaaattaaaaggggtaaaagtcgcctatatcggtgacggaaataatgtcgcgcattcacttatgatcggctgcgcaaaaatgggctgtgacattgcggttgcttcgccgaaaggctatgaagcagaggaagaggcggtgaatgccgcgaaagaagcggcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgctccgtatcaagtcaacgcctcactcgtcagtctcgccaaacccgactatacatttttgcattgcctgccggcgcatcgggaagaagaggtcacgtccgagattatcgacggcccgaactctgcggtattccagcaggcggaaaaccggcttcacgcgcaaaaagcgctcctgaaagctcttctatacaaacaggatgaacaaaaaaaccgctgaatctcattcagcggtttttgatatttctccgcatacaagcgcatactacataaaaaagaaaaaggaggaaatgacgtgggacagcagcatcaattccgcccgggacaaaaagcgccgaataacggtgtgtacgttgaaatcggcgaaacgggaagcatggtcaaaaatccgcaaaaaatcaagcttacggtgggagaaatgttccctgaaacttcaaaccacaacagattgtggacgtaccaacgaaaaccgtgaacacaaaaaaacctgctgaatagcaggtttttttatttaatgctggtttgcatcctgtttgacaggcatgatctccgcaagaacaaagactagcaccgcaataaccacggcaataacggatgattgcttgaaattgtacgccgcgctgttcatggaggcgaccaaataacaggccatatgtgttaaaaggaacgtccaaataaaaccgataataaaccgcacgtttccacctcgtccttcattttattctacgttgtatcataccatacataaagcgcgggcggaaggtcattttctcatcaaaaagcgcgcctgaaactgacatgtgcccgcctgtcttgccgtctgacggaaaattcggttcccgtgcttgggataatagccaaaacatagcagcaaataggagtttatccgatccgttttcattctttttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaactcactttgtcagccgggactcaagcttttggctcgaacatgaagggaggaaccagctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacacttgctcgcagaaggcatgggcgccctcatcgccgatcaattgctgcagtcttcaccggagcatatccgttcagccgcaatgttagatccttgtcttgaccttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgtgccggtacatatatggcaaagaacgaccggagcgccgtacccgtacaccctgcacgcgaacacgtataaagaagcccgggaaaagaccggaagcaagattgatatcacgtatcacctgcttgagaaccctgctcgtatgtacagagccatctgccggtttttccgcagtcatgaaaaagacctgtaatgaatagaatacaacagccatctcttttcagagggctgtttggcttgtgtgtgtatgaaaaaccggaaaggcggcagatgtgatgaaaacagcgctgatcattggagcagatgaatttctcggcctttcattgtgcgaacggttgatggatgaaggtgtgcacgttgatgtcattttggcagaaccggaggacaaaacgaggcagctgtatttagaagaacgtttaatgtggctcgcgagaaacgggctttttcaaataatagagaaaatcggtgaaaaggaatacgatcgtatctgcgttcaatacgggagcgggtgtctgcctgaaaaaagggctgagcctttatattggattgtttacagtgaggatcacggagactgggaaaaaaacggtcagcgggatacggcaaaagcgattatccttcctcccctttacggtccgtggacggaagcaaaagaagatggcgaaagcaggatctttttagaagacgcggtctgcgggctgatgaataagcttgaggctgacggcacagaagacgaaaatcagattattaccctggaaataaaagaaaaaacgcaaaaaacggaagcggaagaaaaaattaaagaatggaaaagacaattttcatcaatattcgacattttttaagaaataccttccatgttatgtgcattaccgctacaataaacgtatatcaattatacatgttatgagtttgaaaaggggttgaacatggcttgatcaccaggcttgtcatgatcttttctgtcctccttttattgagcggatgcacacaaactccgtttaaaggaaaaattgagaaggtcggaatgcttttccccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggttttttcgggggaatgacggccgcccatatgtcaaaaaccaatgaggtcggtgtcatcgcctcctttttgtggcagcctgaagtagacggctttatcaaaggggcgaaatatgaaaagcctgatatcaccgtcaatactgaatttacggaccactgggataacggcaatgaagcgctgcatctttacgagaagttaaaagcggagggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtcaaaacgtataatcaaacaaatgaactgccgtcaaatgaatagaggtggatacacatgcagcatgaaaagtctcttgaatttatgcagatcgcgatgaaatacttgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggttctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgctgaagatatgtattcatccggcatggccgctgaggctgcgcaaaaagcgcttgatcaggccggcatttccgctgaggagcttgatatgatccttgtggcgacggttactcctgaccagtctttcccgaccgtttcctgtatgatacaagagaagctcggggccaaaaaagcgtgcgcgatggatatcagcgccgcatgtgcgggttttatgtacggtattgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactttcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgacgtcatcgtcatggtcggtttcggcggaggattgacatggggcgccatagcattacgctggggacgataaaaaaaggtgaggtgcacacaagatgagtaaaaaaagagtagtcgttacagggcttggagccttgtctccgcttggcaacgacgccgaaacaagctggaaaaatgcaatcggcggcgtatccggaatcggaccgatcacacgtgtggaatcggacgagtatccggcgaaagtagctgctgaattgaaagatttcaatattgaaaatcacatggataaaaaagaagcgcgaaaaatggaccgcttcacgcaatacgctgtcgtagccgcgaaaatggccgttcaagatgccggtctgaacatcacagacgagatcgctccgagagtcggcgtttgggtcgggtccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatctacggggaaattgtcggctacggctcaacgggtgacgcctaccacattaccgcgcctgcccaagacggggaaggcggtgcgagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggacaaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaaccggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaggaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgattttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatccctgcagtcgacggggttgattttcacattaacaaaggcgaaaccgtcgctcttgtaggagaatccggctcgggcaaaagcatcacctcgctttctattatgggacttgtccaaagctcgggcggaaaaattatggacggctcgattaagctggaaggcagggacctggcctccttcaccgaaaacgaatattgcaaaatccgcggaaatgacgtctctatgatctttcaggagcccatgacttccctgaatccggtgctgaccatcggcgaacagattaccgaagtgcttgaataccataaaaaaatgaataaaaaagaagcggctaaaaaagccgttgagcttctggaactcgtcggattctccagagcggaacaagtgatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttccattctgctgatcactcacgatttaggtgtggtttccgaagccgccgacagggtgatcgttatgtattgcggacaagtcgtagagagtgcgaatgtggaggacttatttttaaaccctcttcatccgtataccgaagggctgttaaactccataccggtgatagatggagagattgatacattaaaagcgatcaaaggcagtgtcccgacaccggataatcttccggaaggctgccgattcgccccgaggtgttcaaaagcgatggacaaatgcaaaacagggcagccggagctgataacgcatgaaagcggccgttctgtaagatgttttttatatgaggaagagggtgcccaatcaaaatgacagctgcaggccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctctttaaggggcaggatatctccggcttatctgaagaaaagctgagaaaaagcgtccgcaaaaacatccagatggtattccaagatcccttcgcatcccttaacccgaggaaaacgttgcgttccattattaaagagccgttccagactcaccatatgtacagcatgagcgagcggaacgagcgagtggaggagctgctggcgaaagtcggccttcacccgagctttgcaaaccgctatccgcacgaattttccggggggcagcgccagcggatcgggattgcgcgggctctgacgttgaatcccgagctgattattgcggatgaacccgtttccgcactcgatgtctccattcaggcccaagtcatcaatctgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattacgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaaccggggaacccacactttttaatccactttattctaccgatgttgcaagttctgatattgaaggcatgatttacagcacattattggaaacggatgagaaattaaacgtcaagccgtcgctggctgaaaaagtaacagaagctgacgggggattaacgtatgatgtaaaactgaaaaaaggcgttaaattccatgatggaaaagagctgacggccgatgatgttgttttcacctacagcatccctcttaacaaggattacaacggtgagcgtggctcgggttttgagtcccttaaatccgtaacgaaaaaaggaaaatatgaaattcagtttaaaatgaagaaaaaagatgcctatttctataatgtcgttctcgacagttacggcattttgccaaaacatatattgggtaaggtgccggttgcagatctgggagagaatgaatttaaccgtaaaaatccaatcggctccggtccgtttaagtttgttgagtggaaaaaaggtgagtatgtcaaactggaagcaaatgatgattactttggcggcagaccttaccttgatacagtgacagtcaaaacaattcctgattctaacgcggccgtggcccagttaaaagcgggagatattgatttcttcgttgtgccgggcacagattttgatacggttaaaacgtttggaaacgtgaaggtcaaatctgatctcggcttaaactacagctatatcggctggaatgagaaaaaagagctttttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacggaaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcaattctctatcttccattcaagccaatcgaaaaacgggctgaataatatctggtataaaaacccgaaagtcgataagctgcttgaagaagcgaagacaattacagacagaaaagaataccaaaagaagtatgaagagatatacaaattgattgctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaatatggttacatatattttacggcgaacattaatgtccttgccgattctcttaggcattacaattttgtcgtttgccatcatgaaagcagcgccgggagacccgatgtcacttatgatggaccctacaatcagtcaagcggacagggcgaaattcattgaaaaatacgggttgaatgatccggaacctgttcaatatgtgaaatggctggggaatatgctgcaaggggattttgggacttctatcgtcaagaaaggcactccggtttctgaacttatcttatcccgcttaccgaatacgattgtgcttatgcttttctcaacccttgtcgctcttttgatttctattccatttggtgttctgtcagcgaaacgtccttattcaaaattggattacgggataactgttacttcatttttagggcttgccattccgaatttttggttcggtttgattttaatcatggttttatctgtaaatctggggtggtttcccactggcggagtaagcactttgaatgctgactttaacatatttgaccgattgcatcacttgattctgcctgcttttgtgctcgccacggcagacatggcagggataacgagatacacaagatccagtatgcttgatgtgttaaaacaggattatatacgaacggcgcgtgcgaaaggattccgagataataaagtgatttttaaacacggtttgagaaacggacttcttcctgtcatcactatttttggtttgatgataccgtcatttatcgggggagcggtagtggtagaacagatttttacttggccgggtctcggcaaattgtttattgattcagccttttcgcgggattatccggttatcatggccatgacggtcatttcagctgttttggttgtagtggggaatttaattgcggacatcttatatgcgctggttgatccccgcattgaatattaacaaagagaggtgagaggtcaaatgttacagccaaataccggcacaccccccagcgaagtgaaattaaaggaaaatattcaatccaaaccggaaacaatgacgaagatttttttcgaaaagttctttcaaaataaactagctgtaatcggagccgttatattaaccatcattatcttgtcagctttattcgcttcggtaatcgctccttactctccggagagtcaatctctcatcaatcgtttgaagccgccgagcttaaaacatctaatgggaactgataaattcggaagagacatctttacgagggttctgtacggggcgcgcgtctccttgcttgtcggattcgcttctgtgatcggcgcgattacaatcgggacagttgtcggagccgttgccggatattttaaagggtttgtcgatgcggttctcatgagaaccgttgatatcgtattatccatacctgatatatttttgctaattacacttgttacgatttttcagcccggaatggataaattaattttaattttctcccttacaggctggacaacaacggcacgccttgtccgaggagagtttttatcgcttcgttccagagagtttgtattagctgcaaagacgatcggtacaaaaaaccatcacatcatcttttctcatatactgccgaatgcgctcggaccgattatcgtctcagccacattaaaggtgggaacggttattttggcggaatctacattaagttatctcggtttcgggattcagccgccgatcgcaagctggggcaatatgcttcaggatgcacagaactttacgcttatgatacaggcttggtggtacccgttattcccgggtttgttgatccttcttaccgtattgtgcttcaactttgtcggagacgggctgcgtgatgcgcttgatccgaaaaatgtaaaatgatctcccggacggaacgggagatttttttgttgcaatgcagtcggaaatccagctccgtaatacggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacgccgctgctcagagtgccgtcggtattatttcattacatagaaaacgacttatcagagcttccgaaagagctgcttgaccaagtccaccagaagtcatacgtgcgaaaaaatcacgagcggacaaagctggagtactgttttgtcgtgacagacgggatcggcatcattgccgtggatacgatcgggtataccattccggtcagaaagagccgcctgattccgagacaggagcagcttgtttatgaaatggtaaaggatgtagaaccggaatcgtttcaatttgagccgtcgcaattggagtcttcaaaggaatatcacattttgtcattggcgccggagcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggggattctcccgcctcttttttttatcttcttttccgtccgagacccatggcgttttccattttcttcaccattttgccggccgttttgtttgcgcgcgccgccccttcgtcgagaatgcggtcaagctcgtcgctctcaattaattcacggtagcgctcttggatcggtgtcaatgcgccgataacgacttcggctaaatcgcttttgaattcaccgtaccctttgccttcatatttagcttctaattcttcaattgatgtgtttcctaaaatagaatagatcgtcaaaagattagaaacgcccggtttgttttctttatcatactttacaatgccttcagaatcagtcacggcgctcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgagtcatccgctcaagctcgccgatatatgcgacgcattggagcatccaccccgcctgggcatgagcgggaacttccgactggataaagagggtcgctttctcgggatcaagtccgacggccagataaagagccgcgagattgcggatgttcttccgcagctcaagccgatcctgcggaaccgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatagaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttactttaggggtggaaatcctcaaaaagaactgaaaatgcttaaatgataacgtatatcaacatttcgtataacgaatattatatgtaaaaagcaatatgaactggaaattacattaaaaaaatttagttaggtcatgctttaaactatagaagtgtatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggtaaaaaagacaccaaaggacagacttcacttaatatcaatattaaaaccgagccgttctcactgcatccgggtttagcgaatgattccgtgtcaggaggcgtaatccgacagacttttgaaggattgacacgcgtaaactccaaaggtgagcctgaagaaggaatggcatctaaaattgaaacaagcaaagacggaaagacctatacatttacgattcgtgacggtgcgaaatggtctaacggcgacccggtgacggcgcaggattttgaatatgcatggaaatgggcgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgcggaaaaacataaaaactggaatacaaacgcgggcgaaaattatgtgtcaaacggcccgttcaaaatgacggcctggaaacacagcggttccatcacgctcgaaaagaacgatcaatattgggataaagacgctgtgaaattgaagaaaatcaatatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagagaaaccgctgaacaatgtcaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttatttcaaagacaatgacgtcaaatcagctaaagaattcttaaataaaggactgaaggaattaggcgtcaagaatgcctctgaccttccggcgatcaaactgtcctacaatacggatgacgcgcatgcgaaaatcgcgcaggccgtacaggaaatgtggaaaaagaacttgggcgtcaaagttgagcttgataactccgaatggaatgtttacatcgacaagctgcacagccagaactaccaaatcgcgcgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttatcgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacttaaaatctgtggcgatgtgggacttcgggccttcttttaaatataaaggccaaagtgttaatgatttaatcaattcaggcttccccgtctcattcactctcggtgcagaagctattctcctcgctttagcgttcggtgtgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcagggtgggaatcctgggcatacacctttctgccctccattgcgctcgcttccatgccgatggcgttcattgccagactctcccgttcaagcatgattgaagtgttaaacagcgattacatacggactgcaaaagctaaaggactttcccgtccgtcagtcaccgtgcgccatgcgctgcgaaatgcgcttttgccggtcgtgacatatatggggccgatggcggcatctattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagacgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatactcgtaacgatgacactgacggttccgacggcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtcaatttccatttgaataaaggagagacgctggcgatcgtgggggagtcgggttccggaaaaagtgtgacctcccaagcgattatgaagctgattccgatgccgccgggctactttaaaagaggacagattctttttgacggacgcgatatcgtgccgatgtccgaaaaagaaatgcaggccatcagaggaaaggacatcggaatgattttccaagatccgatgacctctctgaacccgacgatgagagtcggcaagcaaattacggaagtgcttttcaaacatgaaaaaatctcaagtgaagcggcgaaaaagcgcgccatagagctgcttgatctcgtcggaattccgatgcccgaaaaacggatcggccaattcccccatgaattttcaggcggtatgagacagcgtgtcgtcatcgcgatggcgcttgcggcaaatccgaaactgttaattgccgatgaaccgacaacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggtacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggcgaaacgctcggccttgtcggagaatcgggctgcggtaaatcaacgacgggtcgcagtattatccggctgtatgaggcaaccggcggggaagttctctttaacggggaaaatgtccacgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcaggcggacagcgccagcgtatcggaatcgccagagcgctggcggttgatccggagtttatcatcgcggacgaaccgatttcggcgcttgatgtctccattcaggcgcaagtcgtcaatttaatgaaagaattgcagaaagaaaaagggcttacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgcttcctgatccggactatgaaagaaatcgcacgcgaaagaaatacgatccggcagttcatcagctccaagaaggagaaaaaatggaattcagagaagtgaaaccggggcattttgtcatgtgcacagaagctgaatttaaaacctatctataaacgtatcatcctccaagactgagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccatgctgctgtgaaaaaggagcagccgcttgtaaaaatagcgctggctgaaaaagaactgccgaaatcaaatgcacggttcgcttatccgtcagggctgcatttttcacatcctgataaggtgcggggcatttacgtcacagggcattcagcgggaggaagcaaattcggggagctgacagactttgtggacaaaacggagctcaatacaatggtgattgatgtcaaggacgacaacgggaacctcacctttaagccggacggccattctgagtatgccaaaatcgccaagccgtacatcaaagacccaaaaaagatgatgaaaaagctggaggaaaaaaagatctatccgatcgcgcgtattgtcgtatttaaagacagcgaactcgcgaataaaaagcccgagtggtcctttaaagaaaaaaacggaagtgtctggaaaaacggccgcggcgaatcgttcgtcaatccgtttatgaaagaagtatgggattacaatgtaaagattgcaaaacaagccgtaaagatgggttttcaagaaattcagtttgattatgtccgttttcctgaagggtttgaaaaacgtgatgacgaactgacatacggacacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccctacaatgtcgtcaaagaatacgcgaaggtggaaaataaaaagctgtccaagctgaaacacccgcctgtatcgcgtccgtggcttcaggacttcacggcatcatatctcggcagcggaaattatcaaaagtacgggaaacgccaggtggaggaccaggttaaagcgctgcatgatgaaggaattgacgaatttttattgtgggacgcggcaaaccgttataccaaaaacgtcgattacacaccattttaaaaaaattgaaaccatgttaaaggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgaaaaaacggatgaagttctcaaagtcattgatgagaaaaaacaaaaaaacattttcgatcagctgagctaattgagaatggggaaaaatcctccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgccaactgatataagcttacgataagcatggaaaaagcccaaaaccatcgcggtttgggctttttgttatttttcagtctgctggtaaatcatactggcgaggataacaaaaacaacggtcaaaatcggcagcatcatctgtatcatgccgtgttctgccatgaaaaatgacagcttgctgtctccggcaatcatttcaccgccggtaaatgcgagaagaccgctcccggcatacatcaataaaggcattttttccatggcggcatgaacgagcttgctgccccaaataataatcggcaccgagatgaagagaccgatcactactagtgtcagctcaccgtgagaagcgccggctactgcgatgacattgtcaagcgacataaagatatcagccagaacgattgtgcggatggctttccaaagagaagaactgcttttcacatgctgcgcatctttcttctcaatcagaagctgatagccgagatacaataaaaataccccgcctgcgcattgtaaaaaaggaacattcaataaatagaccgcagcgctcgtcagaacgattctcaagacgactgcgataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcggtgttaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccctgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattggtgatcgctgatcatgcgttatatacaataaaaaaacactttgcatcataacaaaccgatttctctcagcagaaatcggttttttttgttctgaatgacaggatgaacggctgaaaaccgtataacggctctcatccgcaaacaggattatgccttctttctgctgaatacaacaagattcaggaaaggagaagatgcaacatgttcagtgcagtgactgccggcggacggctcattcagctggccggaagctattcaaaggaaaaagcggcggagctgagaaagaaacgctggttctgccccgtttgcaaaagtgagcttgatataaaactgggacgcgaaaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagaaaggctggcttttgaatttcaatgtgcgaacctttcggcggactctttaaagagccggacggcaggcctgaaaaacgccgggtaccggccggtctggatcattggggcaaaacggttaaaacggatggccgcgcaatttttccggctttctgcttttcactggcagttctttgaagtcaattcattttcctccttaatgttttactgccccgacgtccgctccttttacaggctgcattccatcactccgttttacaccggctattcttatgccggcttaaccgcaatccctcttcacaaagcaaacctgaaagacatttgtcatccggaagggcggcacagcgtcagactttcctcgtgggggcgtgccgttgccggcttccgcaacaaaggcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacttgcggcttgcggaactttctaaaaaaggcgcgccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgctctcatctcaacagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgacagaagtgaagtaaaggcagagcatacatggagattagaggatatttttcctagtgatgaggcctggaataaagaatttcaagcagttaaagaattaattccgaatttatcttcatttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattctggaaaaagaggagcttaagctttactcccatgcaattgaagaaattacaaaacagcgtccgcacgtgctgagcgaacaagaagaggccctgcttgcggaagcctctgaagcgctgtcttcgccttccaatacattcagtgttttaaataacgccgatattacgtttccgtcgattaaagatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaagtataaatcagcacgggaagcggctttatccaataacagcattcctgaagaggtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtcacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttgatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaaggattcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgatcgacatactgaaaaaagcgggagtcgatatgacatcgcctgaaccgatcgaggcggcctgcaaaatgtttgaagagaaactgaacgaaatggaagagcttctttcgaaagtgaacccttcgtaattcaaaaaagcctgtgcattaaatgcgcaggctttttctaaaaccccttaaacgtttttcggtgattcagccggtacagggcaaacaatatggacagaaacagcagtggagatgtaatgtaaatcggcagcatgtgcatcatggccagcaggtttaaaaagaagaaaaacacaatcattccgatgatcaatacggtgcggagcattgatttccctccttgtttatgattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggtgccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataagatctcttcgtatacgtcataagaatagttgccgggaaccttcagcccttcatcatcatgcaggctgttaaagaacgtcaatgtcggattgacggtgacgtccatttccgccgcgattttcatatcgcactgaagcgcttttaccgcgctttgcgaatggaggtcgcgcttgaattcttcaacatccaatttcgtcttttcagcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgaaagaggctgatcctgctcaagccaaaggcttccgtcacagggcatcccggaacggttcgcaattttttcccaagcttcggcaagaagatgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgtctggccgtcagttccagacgcccgtacagaaattcacgaatatcgccctccagcccgacctgatccatcgctttgctcatacagcttagccacgcatcagccctctcgtccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcggaatgcctccgtaccgatctacgttgccggggcctgcgttgtaggcggctaacgcgagagatacatttccgtcgtatttcgtgagcatctgctttaagtactttgtgccgccctcagcgttctggacgggatcaagcgggtttgacaccccgagtgattctgccgtggaaggcatgagctgcatcagccccattgcccccgcaccgctgaccgctttcggattaaagcctgattcctgtttaataaccgcgcggatcagtttttcgtccactccgtatttttcggctgctttctgaatggcgctgtctattgaaaagtttccggtgctgatgtcagaagccgcattcggagactttatgctcggggaaacggtctgtgaagctgccgcggaaccggatgaaaccggaattctcggtgaatatgaagcgtgagcggtccgcacaccgtttaaaatccctgattccggctgctgccggacggctgtgtccgtatactggctgagcagcgcgctgaaattggcaagcgggctttctgaagattgtccgcctgaatccgtgcttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcccgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattcctagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatgttttttcatgcagagtgcttcactcagcttcaaaaattctgattttgtcagcaggtttttgaattcaatttctatttcttgggtcatgacagtcttcctttcaggacgaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatatctggccggatctgaaagaagccttagaccaaagaaaaccggcggtccttgaggccggcggaaaaacggttgaactttcagggctgcatgaagaactcgattatcttcttgaaaatattaaagataatgcaaactacggagatatggaagaaaaagtgaaaagcgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtaaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcttttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacgatcaaaagcatagaaggcagtctcgtcgctgacgtggaaattaaaggccagctgtttgaaacgttcaggggagacggtttatgtctgtccacgccttccggaagcacggcttataataaggcgttaggcggtgcaatcatccacccttccatcagggcgattcagcttgccgaaatggcatctatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggatgccggcatgacggtaaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcggaaagcatcgctaacggagtgatcagccactaccgaaaaagcggcgtgcaatcaacggttcatcttgtcacccgccttgacagggatacatcgggggcgatgctcatcgccaaacatcggctttcccattctcttttgtcggcagcacaaaaaaaggggcttgtcagcaggcgatatctcgctgtcgtacacgggatcatgctgcagaaggaaggaacggtggacgcgcccatcggaagaaaacacgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacattgtacggcggaaaaaatgagggaattgcccggcaggctcttcacagtgagcggctttcattcgtacaccccatgaccggagaaacgctcgtttttcacgctccggtgcctgacgatatgaaaacattaattgaacacatgtaaagcccgaaccgtttaccggtttcgggctttttttcatgcctgcctgccgtgatcctcgcgaaatcgtgaagcatcatacggcatagagctttccacagagacggtttcatgctcgggaaaacgaaagcctgtcagctgattgccgaagacacagcctgtatcaatgttgaccgtacggttgacgatccgggggcgttttaccggggtatggccgtacacaacccatgccttgccttcatagtcggcagcccagtctcttctgacgggcctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcaggagacagctctttcagttcggctgccgtcgtttccagtccgtgcatcacttttacggggtttccttttaagtaacgatacagtttgttgcaatgatttcccgggacataacggacggctcctttttcatatgcttttgccacaaaacgcatcacttctacggattttgggcctctgtccgttaaatcccccgcaaagacaagcgttctgccttcagaatggacgggcgttccgtctttcacttcatatccgagcttttgcattaaggcgatcatttcgtcataacatccgtgtatatcgctgatgatgtcataagccattcgtgtcagcctccttattaacggttttttatttattatggggctaattcctatacctaattacgctgttttggtacaaattaaaaaaagaattgaagaaataaagccttatcacttttttttcgcgttcagccttgttagaatatgcgttatgtttttaaaaaaagtaaggtttcgtccgcttaaagcgggcttttataacccttgttttaaggaggtatttacaaatggaacacacatcagtcgcatctttagtcgtcgttctgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattccttccgaacggcaaggaagcgcccaacacgttttctgccgcgctgattatctttttcggcatctttattttatcattgctgctgtcctatgcctttgtattagccggttttattcaaaacgcatttttaatgacgcttattatttcaacaatatcactcggtgtggtggtcccgactttaaaggaagaacggatcatgaactccaatatcggccagatcatcctgcttgtcgccgttatcgcagacttggctacaatgattctgctcgctttcttctcttctctttacggagaagacagcggaaatatgtggcttctgttgattctctttgccgcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggatatttggacgcttttccaagatccgaaaacattaacgatgattccgctgcttctgcttgcgctgtttatcagcaaaatgttcccggtgttttatttaaagaaatggtacgacaaaagaaccgtgtttgcttcgggctttttgctgacgtcgacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaaccaaatgacgctcccggttacgctggaattgcctgaggaggaatatgaagtacgggtcgtccatgtgtatcaggaaaatgccggggaaacgcttgcggaatccgttttttcggttgacacgatttctgattacgagcccggcacgcttgagtcgcacggtattttcaaaacggatattcttgtcgtggcgacgggaaatgaagatgtgaacgctgaaatcgccttactggcgaaagagaaagggactgagcgtatcatcgcgagcgtcggctcggttgagcatgaaacaaaactgaaagaagagggcatcagtattttttctatccttctgtctacaaaaacgctgctgcgcgcgttaattgaggcgccgggcgtgatgagcctcttgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacacggctgaaaacaggagaccgtctcatcgtcacaggctcgcgcaactacgtgtcggaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaggtggtttttttattttatcaggggggaagacatgatgacattttctgaagaatgcagacaggcggctgtcgaatggtgggacggaagttttgttcatccgtttgtaacgggaatcggtgacggaagcctgccgattgaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttagggattacggaagaagagcgtgcggcatttaaaccggcaccgaccgcctattcttatacgtctcatatgtacagatcggtgatgagcgggaattttggagaaatattagctgcgcttctgccctgttattggctttattatgaagtcggcgaacacttaaaagagtgcaaaccggagcatccgatttatgaaaaatggatcggtacatacggcggagactggttcagacagcaggtcgaagaacagatcagccgttttgacgagattgctgaaaacagcacagaggaaatccgcgcgaaaatgaaagagaattttgtgatttcaagctattatgaatatcaattttggggaatggcttatcaaaaagaaggctggtccgagaaggacggaaaagaggtggaatcctttggagctgcacgcggtaactgataatcgcaaacccgttgccgagctggccgaggatattctatcgattcagcgcgaagtgagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaagcaggtgcgaagcagatttccccatcttcatatcggacgttcggtccattcgctggaagaagccatccaagctgaaaaggaagatgcggattatgtggtgttcggccatatatttgaaaccgaatgtaaacaaggacttgaagcaagaggcatcagcctgctttcagagatcaaacgcacgctttccatccccgttatcgcaatcggcggaatgacactgcagacgatcggacacacaaagcaggcgaagccggacggaattgccgtcatgtcaggcattttctctgctgaaaatcctgaggaggcggcaaaacggtatgcacgcgcggtaagggaggccgattatgaagaagcactatgatacggcggtgatcggcggcggaattatcgggtgcgccatttcttatgagctggcgaagacgcagcagaacgttgtcttgtttgaaggcggagaagtcggccgaaaaacgacaagcgctgccgcgggaatgctgggcgctcatgcagaatgtgaaaaccgggatgcgttttttgattttgtcatgcacagtcaaaggctgtatgaagcggcggggcaagagcttgaggaagtttgcggcattgacatcaggcgccataacggcggaatgcttaaactggcgtataccgaagaagatatcgcccgtttacggaagatggatgatctgccttccgtcacttggctttcagcggaagatgcccttgaaaaagagccttacgcttcaaaagacattctcggcgccagttttataaaagacgatgtccatgtcgaaccgtactatgtttgcaaagcgtatgcaaaaggggcgcggcgctatagcgttgacatatatgagcatacacaagttacttccgtaaaacgggtgaacggagaatactgcatcacaacgtccggcggggatgtttatgctgacaaagtcgcagttgcaagcggtgtatggagcggccggtttttcagccagctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggtgactggagcgatacgcctgacatcggaggaattgaggccgtcattgcaaaagcgaaaaccatgcttcccgccatcgaacatatgaaaatagaccggttttgggcggggctcaggccgggaacaaaagacggcaagccgtttatcgggcggcatcctgaagacagcggcatcatcttcgccgccggccattttcggaacggcatcctgttggcgccggcaacggctgtaatggtgcgggatatgatcttggggcaacaagtcaaacgggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgatcaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccgtctcggaatcagatattttaacctttgcggtgcggcggatgaacatctttgaagagtctcagcctaactttctcgaacagcttgatttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcggacgatgtcgtgctcgcaagacgtcttgaggagctcggagtgcatgccattatgccgggcgcttcgccgatcggttccggtcagggaattttaaatccgctgaatctttcctttatcattgaacaggcgaaggtgccggtcattgtcgatgccggcgtcggatcttcaaaagacgccgcctacgcgatggagctcggggctgacggcgtgctgttaaataccgctgtgtcaggcgcagatgatccggtcaaaatggccagggcgatgaagcttgccgtagaagctggccgtctttcttatgaagccgggagaattccggtgaaagattacggaactgcaagcagtccgcgagacggtcttccggtatgacggacagatattccagacaggagctgtttcagccgatcggtcccaccggccaagagaagctccggtcgtctcatgccgtgattatcggcgcaggtgcgcttgggacggcaagtgcggagatgcttgtcagagcaggggtcgggaaggtaacgatcgctgacagagattatgtggagtggagtaatctccagcgccagcagctttataccgaagacgatgtcagacaggaaatgccgaaagccgcggcggctgaaaaacggcttcggtctataaatagcgatgtagaggtcgagggatttgtcatggatgtcactgcggaaaacgcacccggattgattcgtgatgcctccctcatcgtggatgccgccgacaactttgaaacgaggctgattgtgaatgatgcggctgtgcagaaagggattccctttctgtacggcgcctgtgtcggcagctacgggctctcttttaccgtcattcccggtgtcacgccgtgccttcactgtctgcttgagacattgcctttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgcccaagctgcggcacaaacgattttccgtttttatcctatgaaaatcagacaaaagcggcggttctgtgcgggcggaacacggtgcagatcagaacggggatttccgaacagtttgatctgcaaaatcttgcggggcagctcagacgggcagggcttgatgtttcagccaacccgtatttaatttcgttttgcacagacaatttcaagatggtactgtttcgtgacggcagagcattaatacacggcacaagtgatatcagcagagcgaaatctttttatcataaatggatcggataatgtgaaaggagcgaaaaacatcatgagcatatgcaaagcattgacgattgccggatcagactcaggaggcggcgccggtatacaggcggatctcaaaacctttcaggagctcggcgttttcgggatgtcagccctgacagcggtaaccgcccagaacacgttgggcgttcacggcatttatccgctcacccgggaggcgctgggcagccagattgacgcggtggcggaagatttgcggcctgatgctgtaaaaacaggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggccgaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcagaaacggcaaaggggaaaaacattcagaccgcgtttgagacagctgtcaattttgtgcgggaagccgtggaacatacactcggcatcggagcgggacacggcccgaccaatcattttgcctttaaaaggaacagtctgcagacgagataaaaaagagaccgcttcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgcccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcatgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgaagccgctgaaaaagagcctgaagcggttcacaatgccgccccagaggaaaagatcccgccaaagcgcgtgaaaaagccgatgagcagaatgtctattcttgaaaaaattgatttcttaacgaagctgccgcataatatgccgcggaccctttgtctgatagaagctaacgggaaaacctacagaggcgtaatcgtcggaagaaaaaataatgcgatcttcctgcggacgacaagcaacggagcgccggcagaactcgcaatagacgatattacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctatggagatcgacttcaacgcaatagttcgttttttctaaacggaatacatcgcagagagagtctttatctgtaaaatcaagaatgtgcttatgctcgtcaaaagcaataagcaggcttaatgtggcacagccgtcacagaccctttcaactctgaaaaaaacggtgttaaaacacggaccgttatccagctcgccgacatttccgaatgcggtaaacggtgatgatttagaagtgaaaagtacaaacggcactgtatcgcctaatgaaaaacccggcgataaaaggttggaatagcatccggccgggcaatcttcctcgaccgcattttgcaggtcttcaatattttctaccgcttcacgcacacagtatgttgtatgcttgctcataatatccctcctgacttcacgttttatataccggattaaacgatatcggagagtcagccgcccggaagtccgggcgggctgatgattgcatctgtaatagaaggttggaaggggattcttctttaggaaagatgcgaatcaatgactatccgtgatgctttttctctttgtgcggctcaggccggtcaacaagctccggtgaaaggcattgaatggcgctgaagcagctcagatcaacttcaatgcaaaaatctgttttttctaaaccgaagaaatccgggtcacaaggatggcagacgctgagggtgtcgccgtgcacatctacggggcgcaatactgaaagcgttgcgcagcaatcacaaactctttctgcccggaagaaaatagactcgaagcactggctgtcatccgcaaatcctccgacgttcccgaatgtggagaacaaaccgccttttttatcaaacaagagaaacgggatggtatctttaccggtaaccgtcgggcttaacagattggtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacaagggtgatgactaagacggcaatcagtaaatttgtcgctgttgagatcaacactgcgatatcggcatctactgttgtcacgtttacgccgcgggagttttcgatgagcaatttttgacggttgatttgtttgttagctgttagctgcaataagtcttgtgcgaccaattcagcgatgactccgtcagcaattgaagtgagagtggccgttacgactgctgcattaatcgctgtcatgactgaagcgactgcttgaacgtctgttgacgttacgttaatatcacaagagtctctgataataatcgcttcttcagaaacttgtttgttgatattcgcctgagccaggtcttggtcaaggaaggcattatcttcgccaaatccatgtccgttacagcaaacactgcatcttcttccttctttttcttctttttcttctcgcggatgttcgcattcaggatcaagtgcaacccaagagtatggtctgctttccatatctattcctccttttcttttactattattaaatgagccggccccttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgttttcgcctgcatgtctttgactaatgcgatcagcatttctttttcttcatcagggatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttaccggacaaggtgcgattcatgaagatcagggttttcgcatatgtataaagaggtcaagttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaataggcatcagggcatttatcggtgaacttctcagctgctattggtgtacgggcgtatggtgcgccgcctttttaattgcggcgcagattgtgatccccgaggccgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgttttctaaaaaaccggagcttccggtttttttgttttttgccgaacgccggcctctgtccggcatagatcataggaggaggggatgttatgaatatatttgaatcattcataaacggtaaataccgccggcacaatcaaaatcagcgggagcatgacaactatatcttatctattgaaaaacagctgtctgagtttgatgaagcgggatcgcgctttgaggaatggatagatgtgtttgccgccgaaacagaagcgaaactgaagaaaaatgagcattctcaataaaatgaaatgaaatccgcaccggccctatgcatttatccaagccaaacaagtcggctcacatagagtatagagagtaaaggaggtgcttaaatatgggattcggatatggcggattcggcggcggctacggcggttacggctgcggcggcggctgcggatacggaggcggctatgtcggaggcggatacggctcaacatttgttcttgttgtcgtattgttcatccttctgatcattgtcggtgcatccttttttggctaaaccttagcaagactttggataagcgcgggaccgttcagtcccgtgcttccctaatgtatgaaggatagagaaggagatgcggaattttttccttgtcttacgggcacacgttccgccctttattcatacaatatcgtattactccacaaaaggaggcacaccatggataatcaatttttcaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttaaacaataaataggcgtcagccggccttgctaaaaaggcctttttatgtgagaagaacccggcagtgatctgccgggttctttatatcctgagtgcgctccgtctgtccgtccgaagaaggggctcgagaaatcttgagctgcgcgctgtttttccccgcctgtacgcgggacaagatacatataaatgctgcatggcccttgtcatggcgacatacaggagccgtctttcttcttcgagcggagcgggatcgccctgtctcgccgtctcaagcgcgaagtcatgggggatcgagccgtcagccgcgcctaaaatatagactgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaacgggcttcattgtccggatgcttgcgaaaaacggaacgatctgcttgatctttcctatttgaaaaggcttcaggtcaggcagtttcgtcagtgccttaatcatcgtgcaatcttccgtgattgacagcgcctttaacgtttgcagggcggattgctttaaaaataaggcgggcagcagatctttcaccgcatccgtatcatcttcattctgactcgcatataagtaggcgaggatctggcgtacgattctgcggctgtagaacgtctgcacgccacggtcggcatgataaggaatcgatgattggtgcagtctttcataaatggcccgtccggcgctgtttgtccggtaaagcacggcaaaatcatcaggactcgccccgttttgaattttctctttcatatccgaaacgatcatggtcgcttcttcttcttcatcgtaaggataaaacatcacgggattgtgaacgccgtctttgacggcagaaagtgttttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgagccatgtcatcaaaatcaaattgccgtttttcccgcttctgccgttcgtaatgttcgtagagccggtacacttttttctcccagtcgtccgcaagcggaatggtctcatgggggagatatgtgtttttccagcagccgataagctgcagcgcctggtcgacgggaaactctttttcatccaaattttcttcatagagcgcctttttcacatattgctctttttgccactccatttttaatagctggctgccgttccattttgaagaatcataatgatagagtattttatagaaaaaactgtggaatgttccggtcacgagacgggagacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcaagcaccagcagggggccgtccgtttccgtgactgcccgcatctgttcgcggttcaggccgatgccggggaacaaagatgtatcagctgcctcggatgttggtgaaaacggttcggccgcaggcacttttttcgggcttttccattctgagacgatcggtttcggattctctgaaatcgcttttcctttcggcaggcggaacatgcctgcctccttatactcttctttttctttctccgcttgtggttcctcggccgcgcatgctttttcacaggcggtgaagtctcccttttgccgatgataaaatgccggctgctctaaaatcgaaagccgcatcaagacaggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaatgaaaagcgaaggggaggggtacatatgatttatgcaggacggattcaaaaccagcagtattctcaatacgcaaaccgggcagcgggttataagcctgattacgccggcattacgaaagcggccgccctcgccaatgacagggtgtacagagaggtggagcgccgccaggaaaacaccgcagccgcagaaaagaaaatgcatgaggaaaaacgtaagcgctctctttctcgtctgccgcaaattatgggaaaaggccggttgataaatcaatacgtgtgaaaaagcccggaaatctccgggtttttttgagccgtatatatgaaagatgcggaaaggaatgattcaatttgagaaagctttcattattaattgcggggttatttctattcggcctctttactgccggaatgaaaccggcacacgcggcggagagctccgcagcaaaagatgtcactctcacacagctggcgccgcatgtctggatgcatacaagcatcggtacggcagacggaagtcccgtccctgcgaacggattgcttcttgaaacttccaaaggaatcgtactgattgatactccgtggaatgacagtctcacagagcaattaatgacacaaataaaacagcggtttcccggcaaaaggatgaccgatgccattgtgacacacgcccatgacgatcgcatcggcgggctgaacacactgtacaaatacggtgtaaaggtgcacagcacgaagctgaccgccgacttcgcccggcagcagggatatgaccggcagctcggagatttgaaaaacgtgacaaagctgcagtttggcgatatgaaaattgaaacgttttatccgggaaaagggcatacggaagacaatattaccgtctggctgcctgaggataagctcttattcggcggttgcttaatcaaggctttagaaacaaaggaaatcataccaactccgggcttttatccggatcagtggccgcgcgccgtccgcaaagtcatgaaaagatatcaggacatcagcattgtcgttccgggccatggcagtccgggggatgaccgtctgctgccgcatacgataagccttctgaaagaaacgtaaaaaagaagaccggcgctcccattacggagtgccggcttttttaactcttcctgatttttacaaaactgaggaaagcaagtgcaagcgccaaaacggtatatcccgctatcggccaaatatgctgatgaaaggaagaataatctccggatatgacttcctgagccagctcgattatgctgaatcagttcttgtcgtaaaagcactcctgccatatcaacaggagtgcttttgattttattgtttgtattcctttatcatttccagatgggggatgcccgcatcgagaaattcttcgccggatgtgacgcggtatccttgtttttcgtaaaacgggaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatgcccgtctttcaagcgccatctgccggctccgaccggctggccgccgtcatatatgactatatgctctgacgtgtcttcgaattgatcaatctcttcttcttccggaacgtgctgttctttaacaaagacctcttttctgacgaaaaaagcgtcgttcagctgtttttcagtttttacgatgatggattccaagcagttattctcctccgcctaataaaaatgtttcgtacacagtccatgagccgttatccagctgatagagcaggtgaaaacggtcgatgacttcttcgtgggaaatgtcttgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtaggtccatttatgatccccgtcgaaggtttcatacgtgtattcagactgtttgctttccagcagctgtttgagctcttcgttcggcacggtgaaatcaaggatctggccgtccgtcgtgtgaacgccggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaaaggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacagaggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatctattttatagtgcgttaatatagaacaatcagaaaatagaaaacaatattcttatcacgagaggtggagggactggccctttgaaacctcagcaaccggtttgctttgccgcgggaaggcaaagtgccaaggtgctaaatccagcaagcgattcacatgcttggaagataagaggaagagaaaagctccttcttcttatgaagagggggcttttttatttttgaaaaaggatggtgcttactgatgacgcagcatgttgaaacaaaattagcccaaatcggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctctatttaaaagcggggatgaattgattgtatcctccgatttatacggaggcacgtaccgtttgtttgaaaacgaatggagaaaatacggcttgagctttatttacgatgatttcagcgatgaagactgtttacgctccaaaataacggaaaacacgaaagcgctatttgttgaaacaccgacaaacccgttaatgcaggaggcggacattgaaaaaatcgcccggattacgaaagaagccggcctgcttttgattgtggataatacgttttataccccggtcatccagcgtccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccgtgaacttgcagaatttttagaacaggaagaggaaatcgccgacgtgttatatcccggaaaaggcggaatgctgtctttccggctgcaaaaagaagaatgggtcaatccgtttttaaaggcgctgaaaacgatctgtttcgcagaaagtctcggcggggtggaaagttttattacataccccgcgacacagacgcacatggacattccggaagatatccgtatcgcaaacggcgtctgcaaccgtctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtcccgatccagcatgcttccacattccatcagtcttcatttgaagaattcgggacatatgactacagccgatcaggcacaccgacaagaacagcgcttgaagaaacgatcgcaggtcttgaaggcggaacgagaggttttgctttcagctccggtatggcggcgatttcgacggcgtttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcccgcgccatccggccgaacacgaaagccatttatatggaaacaccgtcaaacccgacgctcggcatcacggatattaagggcgtcgtcaaactggcaaaggaacacggctgtctgacataccttgacaatacattcatgacgcctgctctgcagcgtccgcttgatctcggtgtagatatcgtgcttcacagcgcgacgaaatttttaagcggccacagtgacgtgctgtcaggccttgccgccgtaaaagatgaagagctcggcaatcagctgtataagctgcaaaactcgtttggagcggtgctcggtgttcaggactgctggctcgtattgagaggcttaaaaacattgcaggtcagactggaaaaagcgagccggacggctgagcggctggctgcctattttgacgggcatcccgccatcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgctgtcgagtccattctctcataccctgcagccatgtcgcatgccgccatgccgaaatcagagagggaaaaacgcggcatcacagacggccttctgcgcctgagcgtcggagtcgaaaacgccgaagatttagaacgcgacttcgaacaggcattgaaaaaaataacccccgcccaagtgagatcataaacgaaaagggcgccgtcaattttgcgacgcgccctttttttatttttgataaaaaaagtgttgacgaacggctggtcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgtagcaagggttttttactttgattatttattgattttgtcatcattcattgagttggggacgaattggggacgaaattatttttttgagctgattttgaagaggaatttcaaaatcaactctgtttttgtgctaggtttctaggatcgaactggttaaagtgttttactgtgctattttcgagtttctcggtaacatgaccataaatatcactagttgttcgagcactggcatgtccggctcttcgttgaatagcactgagactttcgccagcttccataaggagagccaccatagtatgccgcaagtcatgaagacgaacatcttttagaccgtacttcttttttattttagtccattttgcagtaggggttgtatagtagtaaggttttcctttaccactgtgaaacacatattgatgttctccgccttcccatgcgtcgccaagcaacaatttttcttttttccatatgcgataaaatttagccaattcattcatataaaaatcaggcattttgacgaatcgttgagaactttttgactttgggcttttgacatgaggctctccgttaattgttttagaaattgatctatttacgtatattccatctttgtcccaatctacatccaagtgccattcacaggcaagagcttcccctctacgaagccccccgatcagagctgcaagataatataagcgccatttaatatctatttcatacaacactttaatacattcagctgcttcgtcagattcaagaaagttcatttctttattctcagcttctggtgaactcaatccctcaatagggtcgtcttttatcaatttccattcctctgtggcagttttaaataatgcttgtaagattttaaatatatctttgactgtttgatcgcctaatccgccaggctttccatcttttctagccccatctttagataaatcatctataaaatcaacaatatgaaggctttttattttgtctatttttttatggcctaatgctggaagaatgtgattttttaagtgatttgaacatttgacagatgttgtataagagtaaggcttaccattcttattaaagagtttcttttcaacccacttctcgacaaatgattcaaaagtagctttttccggtgcaatatattcgccggtctctacttcaattctgaaacggtgcaactggtcctcaagatactcttgtaattttcgtttagtctttaatagctttgggtcttctatacgaattgttttctttcttctatcccttttacctttggcatcgtaaccattctcaacaattaatctaaaagagttttttccacggtgttctatactggccatttggttacctcctaatattcaatttacttatttgatgaagatttttatgccagagaattgaaaactgttttctgttgaatatttctagccgtttagcggccaaggaatatgtcacattaaatgtatctcctattaatttaatggcctctgatttaagacggggcagctgcatttttatgagcatgaacgttggtacgcagaagtgatacatgaaactgttcgcctggtattcctgaagctgcctgaacattctattcatgtgaaattggtttccagtatgttttaagacatggcatagctcatgaacaaagtcttgccactgttcttgtggagaggctcgagcatcaaggacaacgctatactcaccgttaatttgaaacatgcagctgtctctttgctcataatgaagccagatacgaaatgccgcggcaatcctttctaaatcaatgtcttgaggagtctcaatatttaatttgtaatagatttttttcacttcttcttcaaggtacgataactggattgacattaaaaacaccaccataaagggaatatatgttctgtttttggtgtgaaagaaaagcccgaggaaaaagggctgtcataaattcaatagctgtttctttttaatttcatactcttcttgagtgatagcatccatatccaacaactctttatattttttcaattcatcagctgcagatacagtaggggcaggagctggtggtgcagttgttggagccggcatagactgatgctcttctatgtaattttgaatttctaataccatcggcaattcatttggaccaaaagtgaaggagttatcgtcttgtattgcgtcccagagtccacttgtttcattggcagctggtgttaaaaattgaaaatagccagaggttactaatcctggtttttttatttgaagaccggacagttcgctgattctataagatttctccccactatatcctcgtgtgatagtgttaacagcgccttttcttgctactcttatatagtttccatcaagtgtgattgttgtttttgcagatttaaaataatactctttgatgtgctttttcgattcttcttcaattttcttttgttcttggctgaccttttctttttccagattgaatttttcttcattaccagtaattttggattctacatatttacttactgcctctggatttccttctgttatgttagtgatactgaattctccatctgaagttgtgcaatctatccgataaccagcaagagcttttttagtaacagacattttcaaaatagaatcgtaaggccatttctctgtaatcagtgcatcctttttaagatagaagaaataaacataatcatctgttacggcaaatataccagtaggcatgctgacaactttaggtctattcaagctacctcttgcaatttccaatacggtttcgtttagctcactaagcatcattttataagtttttacaaagtttttagaagccttcatgtgttttttgaattgacagttatacacttcaccattctctgacaaaaaagacaaattgaatttcccctttatagtaatcaagttgaacttcctactttttttctgatccgatcccgtttgaatccagatgcaatccggatgagaaagaattctatatcccttgatataactggcttcaacctactggtgaaaaattcttttccgatccagttcagatttaattccgatccaatcccgatcttattagtaaacagaaataacataataaataatataaataaaggtttccccagtatgttactttttaggctttcggccttcgcgttcttctttctctttaaggtactttataaaatcaattgcctgtttttgactttcttctgagaaatcacgagcttctctaaacgcaagttgtaaatcatcatctccgaacgcttgttcaaactctgatgtttctttaataacactcgagtgattatcaactctacctaaaagataatcagtagttgtatcgagagcgtcagcaaggtcacgtaacatttcgtttgaaggtgtactgtgtccgttctcataattgcttatagttcctttggtggttttgactttctcagctaactcagtttgagtaagttttttttgttttcggcaaatctttaatcttttagacaacatttggattttcctccatatcgaagtacaaggtaattgtacaacaaatgagaagtgaattaatatttgtataagaaattcatactttttgttgacatacaagattcttatacttataatgaaaacataaagtacaagaatcttatacaggaggtgagcgaatgaaaaactataaacttgtgaatgccagaaaagctaaaggcttaactcaagagaatttagccgaaaagcttatgtataaaaaatccactgtttccaattgggaaaatggatattccactcctaaaatggaagatgcttttaaagtcgctgagatattggattgtgatattaaagagcttttttttaatcaaaaaggacaaggatctcatacaaatacagcttaggaggccgagtatgacacgcaatacattaactgtgcaggaaacagctgattaccttggcgttcatcatgacacaatttacacgatggtccgagaaaaacaaattccacacttccgagtccggaatcgcattttctttaccaaacataacattgatgcatggattgaagctcaggaacaagcgattatgaaggaggcgatagggtgaatcaactcgtcttcattgaaggtaatcaagttgtaacgaacagcctgactgtcgctaaagtcttcgggaaacggcatgacacggtcctgcgggatatcagaaaccttgattccagcaaagaatttaatctccacaattttgcggaggttgactatcaggatgaccgaaaccgaacatacaaaaaatatctcataaaacgtgatggactcacattcttggtttttggttacacaggcgcaaaggccgcactgtttaaagaaaaatacattgcagaatttaaccgaatggaagatgagcttcaaagactcaatcagccctcttacatgattgatgatccgatcaaccgggcaaagcgttggatcaccgaagaggaagagcggcaacgacttcagcacacactgaagattcagcagccactgatcaactttgcagagagttgtatggcatctgaaaaatcattacttgtgagggaactggcgaagcttgcatctaaaaagggtatcagcattggagaaaaacggctgttccaaaagctacgcgagtggaagatgatcttggcaaacaagaacgagccataccaggaatatatcgaccgtggttattttgagatagcacagggagtgcgacaagtaaacggttcatctaaatcatggctgactatccgcattacgccaaagggacaggcctttatcatcgacaagctgagaaaacagcaagcaagctagttccttcattaattaaattttaccagtgagcaactggatatatcaggaggcaaacatatggagaacaacccatacaatttgcataatctaccccggatcatgcgtagtgtccgcaaagcggcaggacttgcacagtatcagatcggaaatttgatagggggaaaggatcagcggtatgtttcggacgttgaaaatggattcagtaagcttaccccggaattatgcatcaagtggtttgaggcgtgcgaggcatacgaacatattgatctggtacattacctcttcaaactgcacccgacgacggcggcgccaatagatccagcacttaacgagagcgcaagcgcggcggtaatcaatatgattcaccagcttgaagaagcattgcaagcaacaaggcatttagcgcgctggctggcaaacgataggccaggccgacaaccagaagaactgcccatggccgatattaagcagatttttgatctgatcccggcaaacaaaacgctgatatattcgctggcccgtagccatggactgaacatgaaagaactggccgaaaggtggacgcggaaagcgttaatgagtcaagttgcaatggcaaaaacagaggaaaggcaggcggtactagtatgaaaatcaatcagtttcttaaagtagatgcagattcagcaaaaaggaaaatcgaatcggcggaaaggctctctatcatgctttcggaagcgttaagggatggcgattacgaagaagcaatcagtcttgcagggagcatcaaggttcttacagaggatattaaccggctggcgaataaagggcgcttacatcaaaccgtcttaaatatggcggcccgcggaattcacctgagtgttgtaagtaggtgttcacaatgaatattgaaaatccaatggttctgaacaactggcatgacaagctgactgagccggaaacgcaaaaggatttctttggggatgaagtaacggctttcgatgatttcgtgatagatagtgctgaaggtgaagtcatattgagggaaaaccttgagcggtatctgaaggagcatcttggttttgaatttaaaaatgagcaataaaaaaagcccacttggcagagtggacttcaaaaggtcttttggtaaagattagttcctttattataccaaattacctcataaaagacaatggaggttttacacatggcaaaacgaataacagcatctttcagtgaccgggcggacgatcagaagcgcctgagagaagtcggcggctcaatcatgttcagtaaaggcaaacccgtattttcctttccgtcaatggatgcataccgagaatggcagcggctcggcacaaaagcttatttgagaaaggtggcagaaacacaatgaacggactatctcaggtagattactcagattacatgccggcgccccagcaggctactggcgtgactacagaagcgatggtaagccgacaggcgcaagaagtacaggcggcaatggtcatcgcaaagaaattcccacgggacgtatatgcggcttttgaccggattaaaaaagcatgcgagcggaggctgttagccgagaatgcggtgtatgaatatccgcgcggcggcacaaaggtttccggcccatccatccggctggcggaggccttggcacagaactgggggaacattgattacggaattatggagttggaacaaaaagccggagagtcctctgtcatggcttacgcttgggatcttgaaacgaatacccggcaaaccaaaatattcactgtgaagcatgagagaaaggcaaaaggtacagtgacaaagctcaatgatgcaagggatatttacgaaatggttgccaatcaaggagcccgtcgactccgttcctgcatactcggagtgattcctggcgatatcgttgacgctgcagttgatatgtgccagaaaacgttaataaacggccataaagaaccactggaagatcggctcagaaatgctttatcaacattcaaaaaagaattcggaatcaccaaagaaatgattgaagaatacatcggcagtaatgttgatgccttcactgagcaagatttcctgaaaattggtcgtatttacacgtccctgcgtgatgggatggcgaagaaagaggattacttcaatgtgaaggccactggcgcgactaaatcaaaggccgaggaagaattcaaaaagcagaaagagcaagctgacaagcctgctgatagtaaagaaaaggcgggtgatcctgctaatgcggataccggcgctgagcaaggagaattattactctaacgagattgatagacactacatgtcaaattctcaatataaaagctttttgcaatgcgaggctgctacgatggcaaagttgaacggagaatggacgccgcctacatcggaggcgctcctcttcggccaatacgttcatgcctggcttgagggtgaacaggcttttgatgaatttaaaaagaacaccccatcactttttacacaaaagggccagctgtacaagcagtatcagttagctgacctgatgattgaggcaattcaacatgacgaactctgtatgttcattctgcaaggagcaaaggaagttatcgtaacggctgaactgttcggcatcccgtggaaaggcaagctggacgtatacaaccctgccggcagccgtttagccgatctgaaaacagcccgttcactccgggagagggtttggcatccggaagtaggctattgctcattcgtcgaggcaaatggctatattgcacaaatggcactgtatgctgagcttgaaaaaagaatgactggacggagcgaatggcttgagcccctgatcgtaggggtgtctaaagaggacccgccggacaaagcggtgatcaatatagatgaaaaccgaatggaagtagaacttgaagagattgagcagcggatggaccgaattttgcaagtgaaacacggcggagagaagccggagcgatgcgaaaaatgcaagtattgccgggccactaatcaactgaacagtatcatccatttttcggagttggtgagctgatgaaaagggagctgatcaggattcctatcccgcattgttatctttggctggtcaaaacggttcagtgcgacatgagaaaggacttgtatacccggtacacgactgactacttaaagacaaatgagccgtctctgagattagtagaaatagatttcaaggctctgacagcactgtgtgaaaggaagtaggtgagcggcatggatatgcaaggtttggggtatgtggtcctgccccggctgccatttaaagattcacgagacgagacaatatacgattatttattcaaacgggcggagtacagggcagatcaagaactaaagctcgggcagacaatcattaagcttgtagatttagccaggcgcttcaactggtcttctgatcagatcaaatactcgttagatcggatggtaaagcaagagtatttgaagctggatcggctgccgcaaaaacgtggtttcattgtgacggtgttgaattatgccgagtacatacagcttggaaattacaacaagaagatagacccggctccaatacctttaggacagcaggaggttgacgaaaaaatgaaaaacgcatttgaactattcgaaaacaaaacagcccgcaccattggcacgatggaggttcagcggcttgggtatatggtggatgattacggcgaagagaaagtcatggaggcgatgaaacaggctttcagaagcaagggaaacaacgtcaatctaaattatattgaagcaatcctctcaaacccattcagccagagacgaaaggagaaacagcagtatgccaacaaacaacagaacacaaagtacggacgaggcgatggcggcagtcatgaaagaacttcaggaaaggtcagctcaattttcggcggacaagtcggccgcctcagaagaaaaggctgagtatgactgtcaggtatgcaaagacgaactcggctatctcgaaaacaaggacggttatcaagtgtgggtacggtgtggatgcattgagcggcgccgcatccggaaattaatgaattccagtgacatcaccccagaatttgaaaggttgcaattcaagaattttgtaaccgaagggaagccggaaatggtgaaagtgacttacgatacagcggtcgaatactacaaggagtttgataacatacgcggtactcgaaacaacagcatcgccctgctcgggcagccgggggcaggcaaaacacatctgcttactgcaatatctaacaagctgattaaatcaaaaaatatcgcggttcagtattttccatacgtcgaaggattcaacgatctgaaagatgattttgacaagctggaagaaaagctcaagcgaatgaaagaggttgaagtcctgtttatagatgatctgttcaagcctctgaatgggaagccacgggctaccgattggcaggtcgagcaaacatactctgttatcaactatcgctatctgaaccataaaccgatcttgatttcaagcgagttgaatatcgagcagatcgtaaagatagacgaggcgctcggcacccggatttacgaaatgtgtgcggattatgttgtgatcatcaagggagacagaatgctgttaaatcatagattggcgggattgagaaatggataaacaggtaaatttcacggcatccggcggcatgtatctgttcgggcccgccgagcaaacggccggccaggaccttaccccggcgatccgggtgcttgaggaaaaaatcaaacaaatggagctgatgcacagtgcttaaagcggttatcctgctgccagccatcatcctcacagcgtcgtacaaggaaaagcagattcagcactgggaacaaattgacgggaggtaatgacggttggattccattcagtttatagtttacggcgagcctgttgcacaggggaggccgaggggatctgttataaatggcaaggttaaaatgcgtgatcctttgaaatcaaagaattttaaacaatatgttgcactggtggcgtcacagtatcggccaaaacaagttattacgggacctgtggcaatggatgtcagagtattcagaccgatgccgaaagctgtatccggatccaagaggaaaaaggagaacgctgagaaagggctgttacgccctgtaacaaagccggacgtcgataactacgtaaaaggtgtcaaagacgctttaaatcatctgatatacaaggatgatagtcaggtagtcgatttgaaggtcagtaagttttacagtgaagagccacgggtggaagtcattataactgagattgtgtcatgacaggtagcttttgtagagatcctaaatcaaataatcaggaggtcaacaacatgcaagaaaaaatcgatccatacaagcctggtccagttaagaagtggaaaatgacgccggagcaattggcagcttacgtcgaaaagcatccgatcatctaccgcgaggaattaaagccgtctgcgggcgtgacgatgcggctgccgtcgtaaaacgtaaaaaagcaccgaagccgtagccccgatgctctgatatgaactggtacttctatcatagcacagggggcggccagagtgaacaagccaacagaaataaaaaatcatgaaacaactattcagcaaagcatcgagccggggaaagtccgtatcatcgttttagatggcactgaagggactgctcatctaatggacgccccggaacacggtaaaacaatcattcaaacaataaaaggcggcctggctcgttgtgattacgagatcggccataaattcaaatagcaggggtttcccctgcgggggaggaacgggcatgaaagaaagaattgaacgtctgaaaaaactgacttacattcctaagaaggaaattgcttggcttattgagcaagctgaacagactgttaagcagcaggaaatcatcgaggaaaacaagcgtcagcaggaagtaacagttcatcaatttcgacaggcacaaaaggacattcagcgtctaagcggggataggaaacgatacaaacaggcattagaaaagatcattactaatctgagtttcgcgataacagttgcccaaaacgaattggagggtgcagcagaatgatgccattacaagtagaactacaacggaacgtgaaggccacgaaggacgaagcaatgactgtcgagcaggcggccgagcttttaaaggttcacccggagtacatcccgacgctggtcgctcggtctgacgatctaaaaatgatcggcaataccattatcgctaaacgggataaaacaaatatctggctggttgggggatgcgtggggcttttcttttttgctgtctctgtcctgccgaatttgatcgggggttaagggatggcacgctcaccgttaatctggtttagcggcaaaggtcgatacgccgatcacatgataaataaactgcccgcatataaggtgtaaattgagcctttcggcggctcggctagtttatatattaaatagggggattcaatggcgctgagaataatttttatgctaatgggattaggattctggttttattttcagtacgaatataggccggacatgaaagcaaacatcacattaataggcgcaatcatcgcattcacggcagcggcgttttttcaagatattgataagtatagagagaaaaagagataggcgatcatgattaaaactgatataaattcttcacttgatttaaatcctaatattgccgatatgatataataggttttattgtaaataatagctttaggttctctgtacaaattaaaaaagacatctcaattggggagaggtgtctttttaaagcttagtatgttcattaatcatagcgcgtgcttcatcttcacttatcaaattatatatcccactattatcattaatgactccatttatgactagtacttcaacatgttggtagtataacgatttatttataacaacaaaactatttaagttgctgataaaattaacttccagattatttaaataagatttgggctgcaagaaaacctgaggtttactattgtccagtgaattgagttgttcgtatctgttaacatcaataattagggcgtttcttccgtcacctataccaggaacaactaaagttagagataatagttttggtgttttcttctcaagttctaatttaatatcatcttttattttatctagttttagtaaatattctctttcttttttatcaattgttgatttaaaccagctttttgctaaaaagaacaaagcagctccaatagcggtaataacaaatgacaatacaacccacatcgtaccaatattaaatttaacattactatcaataagttgctgcatttcagaaagtgaattaattttttgttctaattcgtttattttcaagtttgaattctcctatcgtaacttattccgcacttaaattataaacgaataatacaataaaatgaagaataagataatttaggaaagattcttttatgctctattataataaagcctatttaatagcatatatttctccaacaatttaagcatattcatcagggaaattcgacttgatgctataacattatatacccattctttatccgaaagtcattaatccataaaaactgtttagcgacttaaccagttaatcaattatctgtctcccattaaataagtccaagacggaaagcctgcggacactgatcattgcacagaattactgtgctctgattggtgtccgttttttatttgagcggagggatgacatgaagcaagaaaagaaaaagcccaataaaaacacgcaggagcgatcagatcgtttttggcaacaaatgatgaacacaaacatgcaaacacttaaacgaggcaagggcggcgcatttaagcgcaaataagggggaggaattagaatgcaggatttaatcattgaatacaaacgagctttaagagaaacaagaaaaatgtaccggctctacaaagatacggctgaagtcaatctgacggctgaacagattaacgacaaaaagattatcagtagcatgatcagtgacattgaattcactcttgaatggctgcagaaaggaagacagccgggcgcccgccgaggtgctgacagaagagatgcatatcaaaggacgattcttgcagatccgcgcttaattgatgcgctcccggaagaatacgcaatggttcaagaggctgagggagaggtaagtgattgggataaggaaagaattgctgatgccctatccgtgcttaccgaaagagaaaaggacattttcatcatgcatgctgtgcaaaacatgtcattcgaagagatagcgcagttattggggattaaaaaaggaaccgtgcagaagaacatcgaacgttcccgcctgaaaatgaaaaatagagcagatcacagcctattctgtttagcgtgaataggctctttttttattggagaaataatgaaaaaagcccattaaattacttgacgtaagtaaagtattggagtataattaaagtatagaaaggagggaaagaaagtggctgaaatcgcattggtactggggattatcctcacaactctcacggttgttgaaaaagtcctcatcatcagggaaaagcttaaaacaaaaaagcccaaaatcaaaaaacgccgtcgaccaaaaaagcgcagatgattttgagccgagggagaaggtagcgcttctcccttgctccaagtatagcaaatgcggcgactaaagaaaaatacttgaaagccagccactttcaaaaaaatgaaaagtgtacagtccactaccgatattgttgttcttctcgccctggcgtatatgctgtttttccgccaggatgtggcagcgggaccattgaaaacggctctcgacattagtctgatcattttatttgttgtttcgatcgttgagaaagcattttccctttacttgaaatatcgcgagaaaaaaggatgattcaaaaatgtacaagcctaaagagcgtgacgcaatcaagaaatttctgaatgaagagatacttaatacaagtgaagcgcttgagattttggggttcacccgtcagtatctgaaccagttagtaaagaccggggaattagagccgatgaaagaaatgccccgggacaggctttttctgaaagaggatattttggattttcaaaaacatagaaggaaatgagcaaatatgaaaaaattaatcgatggttcaacgatcttattctttattctgtttgtgatattgttcactaattttaattatgatgatctcagcactctcgatattattactatgattttggcaatgatctggttggtattgactataattaatataaccctaaaatggagaaacctccgaaatggctaagtttatttttgaaagtatagacgagctgagagattttatggataaagaagtcataacgacatctgaagccattgagataatcggatgcagccggcagaatctcaagcagctggtggattataaaacattggttccgattaaaactacgaacagagatcgcctattcttgagaaaagatattgaaggctataaaaagaaacgttgattgcaccctgtcaaaagggtgttttttgtcttacggttgccacctatttatgaagagcgctttcgttcgacaaattttgcaaatagttcctttatcatactccttaaccgataataaggtg

SEQ ID NO: 115 - DNA, 104411 bp, Bacillus velezensis FL50S
ttaccgcttggctatagcccatcggatgtaattacagtatgtgcgtccggcgccgatttatacatacaaagtaatttgaatggaggagacccgtgaaacatttgaatgaaacattatctcgaaccttaattgaagaatcaggtgaaatcacacgccagtggctgctcataccaaaatcggggcggccttcagatgatcagaaagcggaaatgcagcaccgtctgttaattgaaatcgttgccggcattttatcggaaaaagaaggcggagaagaggagctgacaaagtgggcgcttcagttcgcaagggaccgggccgtccatgaagtaccggtctatgaaagcgtcacgagctttaaagaattccggagattggtctggaaccgtatacagacatgctgcgaaacgatgtctgagaagcccggggcgaatgcggtattccattggggagagaagctgaacaaagcaattgaccatatgattgaagtatttacagaggaatattataaagtgacggttacacaattaaacgcccaaaaggaaatgattaacgaactgagcgcgccgattatgccgattgccgccggtattggaattttgccgcttgtcggcgaaattgatacctaccgggcaaaaatgattttggaatcggtgcttgaccaatgttcttcactccggctttcttatttatttttagatatatcaggtgtgccgattgtggatacgatggtcgcttatcagattttcaaagtgattgacagcacaaaacttctcggcatagaaacgacaatctcaggcatcaggccggaaatcgcgcagaccgtcgtgaagctcggcatcgatttttctcaggtgaaaacggagcagagtctggcgaaggcgctggcaaaaaacggatttatcgtaaaagaatcattaagatgataaaaagctgaatggccgggagggatttctccctcagctattcagctttgtcagcttcaatcgtcatgatatgatggctgtcgatttcttttaccgtaaatgtgtagccttcaaaatcaatggtgctcccgggcttcgcgtcaatatgctgagtaagaaaccagccccccagtgtatcgacttgatcagccgtaatctctgttccgagtaaatcattgacgtcactgatcagcaatttggcgttcaggagatagcggttcttcccaagcttttgaacggaaggtgtttcgtccgtatcaaattcgtcgcggatttcgccgacgatctcttcaatgatatcttccgccgttactaaccccgcggttccgccgtattcatcaatgagaatggccatatgggcgtgttcccgctgcattttaacgaacaattgataaatcggaatcgtctcaatcacatggatcgccggctgaatgtaagggctgagttcgtgttttgtaaacgccgctccttctgacaggaatctgaataaaacttcttttatattgatgatgccgactacatgatctttatctccttttacgacgggataccgggtatatttatttgttttgataatgtcccggagcatatgtcccgatccgctgtctaacggcaggctcaccatttcattccggggcaccataatttctttggcagtgcgcttatcaaatgtaaaaatgttatttacgtaatgcagctcactttttttgatcatgccgcttcgatagctttcggcaaggagcacccgcaattcctcttccgtataagccatttcatgttcggaagcaggcttcaagccgaacatggctgtaatcaggcgggcggaatgattgagcagccagatgaacggaaacattaacttataaaacaaaatcatcggtctggcagacaaaagtgtaatccgctcggctttttggatagcaaaacttttcggggcgagttcgccgatgacgacattcacatatgtaaccagcagaaaggcgatgatcaatgacagtacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacatcttcctcaatgagctgattaatacgggagcgccttgctttaacgattgaaaactctatggcgacaaaacacgccgttaataatataaatagtacgatggcggatagtttgatgatatacaatgtaacgccttccgcgaaggaaggcttgcacctcccttttttcggaataataccactgtagaaagctgctcaaacatcgaacctggtttagcccgcctcatttacggtaataaaacaagaaagcgatactggaggatgacaagagatgaatgtacattcgggtgcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggatctttaatctatcatcaaggattagatgatgaaaaaaaccataccgtatttcacttttatattacgagagacttcttttttacgattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctaaaaaagtggaaatggctttaaaagaagcgtttcttccgaaaaatgacaggcagaaagattacctcagagctcatcataagatggaaagagggattacatatatcaatgagtttgatcaggaactgagcaatctgctgcacgccgaggaagtcattacctcccaaagaggaaatgaaattgtgaaagccttgacgatttttacaactctctttacaccgatgacggcgcttggagctctctgggggatgaactttgataacatgccggagcttcattggaaatatgcgtatatctgttccatcgtgctcattattgtatcaaccctgctgatttatatttatttgcggcagaaaggctggacaggggacattttgagggagcatcaaaaaaaatatttgcggaaagaaaagaaacgctaagaagagcaggcatacgcctgcttttttgatggctgaaaatggccgaatggttccggatttcattcagtaaatcaatgtcagggggcttattttttatttttttgcgttttacacagtgtaaaacgcataatctctcctttgccggcttttgtgtatctgatttacaatacgtgcggaaggagggaagtcttgtgaaaaatattgaaacatacagcaggaacatcataaacgaggcctatacggcaagggcttcagatatacacattgtgccgagagaaaaggatgctttcattcattttcgcatcggccatgctcttgtgaaaaaaagagtcttaaaaaaagaggaatgcgtaaggcttatttctcatttcaagtttttatcggccatggatataggagaaagacgtaagccgcaaaacggttcattgtctctgccgcttccgacggaaaccgttcatttgagaatgtcaaccttgccgacaatgaatgatgaaagtcttgtcatcaggcttttgcctaagcggcagattccccctctggataaactgtccttatttcggggggcgggcgccgcactattgtcctttctgaagcattcacacggcctgcttctgtttaccggcccgaccggctctggaaaaacgaccactctttactcgcttgtcaactatgcaaaacggcatttcaaccggcggattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagagatgccgaaacggctgaaatcgcagtccgcgcggccatgacgggacacctcgttctttcaagcctgcatacaagagatgctaagggcgccatatacaggctgctggagtttggggtgaacatgacagaaattgaacaaaccgtcattgccattgccgctcagcgtctggttgatttaacatgtccgttctgcaaagaggaaaactgttccgtgtactgccggatgtacaggcagacccgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacaaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgaaactccagctgcataaacgtcagcttgcagagctgacggacggaatccgcaggctgagggaaggtgatgcgttttacgaagtgcttgaggcactgtcttttcataaagaagccgtctctatctgctatttcgcggagaaacacggagaattgccgggggcgatgaaacaaagcggcgatttgttacagagaaagctcatgcagacgaatcaaatcaaaaaaatgctccggtatccgatgtttttaatttcttccgtctgtgtcatgttttatatcctgcaaagtttaattattccgcagttttctgggatttatcaatcaatgaatatgaatacatccggtgcgactgctttcatctttgcattttttcggcattttcatgaagcctgcgcactggcgctgtccgccgctttctgcttgtttttgtacgtttggttcttatgtaagaaaaaatccccgcaagataaaatgctcattgttgtgaaaatacccctcttgggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtgttatgaaaaagatcttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcgtctgaaaaatcaagatgggtttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgaccatgaaggtaaaatgccggatatgaacgatttacaatcagaggggtatatcaaaaagaatacagcctgcccgaatggtaaacagatcttaattagtggcggagaagttacagttgaacaataacaggcggacagaaaacgggtttacccttcttgaaagcctgattgtgttaagcctggcgtccgtcctgctgacggttttgttcacgacggttccgccggtctgcacccaccttgccgtgcggcaaaaaacagaacagcttcaaaaagatattcagcttgcgcaggaaacggctatcgcagaacataaaagaacaaaaatcacttttcttccaagagagcataaatacaaactgcagtcagccggaaggattgtcgagcgttcttttgattcgcttcacattacacttgtgactttaccggagagccttgaatttaacgaaaaaggccatccgaattcgggaggaaagattcgattgaagagcgccgggttcacctatgagatcacagtttacttagggagcggaaatgtccatgctaaacggaaataaagggttctctactattgaaacactatcagcaatggccatttggctgttccttatgacgtctatcattccggtctggacaggcatgctgacagatggtctgaaaatagaagatcgccaggaagcgtatcagcttcttcagaaacatatcagcacttatatgatgaccggaaaaaagccgccgtctcccggtgtgaagtggaagggggatggtgagtattacaaagtgtgtgcggctgaccgcggcgaaaaagaaatgtgcctcagcattctcaaaacagactggctttacgcttcttaatgttttgttctccttggcagtctgtcttttcctatcaggcaccctgggcccgattttacatctgtttttatcaaaccggaccgataacggcggattagacagccgggagcatcaaattgccgttcagcagatcatgaacgaatgtaaacaggctgagactgtgaagccggcggacggcggattggcgttagcatgccggaaaacagggggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttacaggtaaaaagaatcaggcggtcattccggtttacagctctttaaaaggtgattaaatgtacaaatctgacggttttatctatcccgcggttctgtttgtttctgccgcagttttacttgtcatcagctatacttcatctgatttcatcacccgaaaaacatttgcgaaagaggccggggagtactggatcggagagaatctgctccaaaacggcgcgctgctgtcaagccgccatatgacacagggacaaaaggtccaaactggtacacagcgttttccgtacggaactgtttccttccgcatcaccgggagtaatcgccgggaaacggttcaggttacaattcaggccgaaacagtgtcaggcacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtacagttttaagctgtggatgcagcggaaaaaataaagcgaatcacacgaaaggtcctcctgtatcaggagggccttattggtattcctcaatgacggcaattttatttaccttttggctgtagggattaaaagaaatcgtaacaaacacaccaaattcttttgcgccatcccgcaatgtcaagtggtattgtttgactgcttcgtccgttcttttccggtcccacaccttttgaataaataacgtttgggcgagcggatatctttttttagcttctttttctgctaacttttcccattttgatttatggtgaacagcataataaggcaccgtttccgcctgagctgttcctgaaaccccgaaaacaagaagagaaaggcaaatcagactttgtgtgatcatcattcttcgtcctttcgctgtatatactttccattttgtgctaggcacctcgttattttctcacgttttattagaaaaaattccaaaaaggtgtgtaatttgaagcaaaacgatgtttttgaaagataccattctcaaaaacgaacaaattgaccgattttgacatttttcaagacgataatccttgattatactttgttcatgaagttctttaaagagaacggttgtcatatttattaacagttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtgaaaagcttcagtctcccggttcaaacgtgcggagattttcaatatacggatgacgattgccgttatgacgaacgctgggatcagagtgatttacatataacaaatcaaactgatacgtcaggcaccgtgtgtgcgccgcttcaactctatgccgagctggagaataagggaaaagagcggactgtttctgactggaaatgggagctccataaaatcacttctcagcagcagcctttacgaaacggcaatgttgtggataaagggcttattactgataaaaaaagcaaaacgatttataaaattgagtcaaagcggtctttgcagccgggcatatacgcattcaagatttacaagcctgaagggtatccggcggacgaagaacaatttgagtggtcaaaaccgatgaaactcgtcaaatgccgggaacaggcaaccgtttccgatctgaagaaaacggagaaagagccggctgagccggtaaaagaaagcggggaagaacatgaaaaaaacgctgaaactgatcagtaatattttgtatgccgtcatcttcagcctgattattgtgctgacgttaacggtgatttcgacccgggcttccgggggtgagccggccatcttcggctatacgctgaaatccgtgctgtcgggttcaatggacccggaatttaagacgggttcgctcatagcggtaaagaaaatttctgacgtaaatgacttaaaaaaaggggatgtgatcacctttacgcaagatgacggaacagccgtcacacacagaataatcgggatcacaaaaaaggacgggaacctgctgtttgagacaaaaggggaccataatgccgccccggatgccgcccccgttcaagctgaaaaagtggcggcccagtatacgggatatcagcttccgtatgcgggatatgtcatacatttggcaagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagagaaccatctccacatgaatacggttgcaacctggcgacaggatttgataacaaaaaataaaaagtaaggggagtacaaacatgggtatgaaaaagaaattaagcttgggcgttgcctctgccgcactcggtttagcattagtaggaggaggcacatgggccgcatttaatgatgtgaagtcgacggacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggcaatgaatctgcggaggatttcctcagccagtttgaaattacggttctgacagtcggtaaagaagggggcaacggctatcctaaaaatatcattttaaaggcggccagcctgaaagacttatacttaatgtcaacaaagcaggataaagcagctgccgaagcgatcagcaagcacattgatccgaaattcctgagcgagagcggaaaagtcaatgtggcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagccacgcaatggaacggcttgaccattaagaaagatcatacggataaagacggttacgtcaaggaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcttctgtctgctcataaaactgatcgagcagcctgaggtcctttttccatctggcgatcgcgctgtcagcccagtctgacggctctttggaggcagcgtcttttaagtaatgctccatccttttaatcccgctttccggcttaatcatcggcgatatggtaaagcaatagtctgatatttgcgaggtcagcggaagcggtgcaagcttctgctgaaacccttctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaactcgccgtccatatcctccggagccgtttctttatcagtgatgaacgtaatcttcatcgggttcggttcgccgcccgttttttcacgccaatgccaataaaacgggcggttcataatttgtttgtccatctcgaccgtcaactgaaccgtcataaaacccggcccgtgttctgtaatcgggcagtggttcgcttcaaaaaagcgcagtaaaaattggtgaacctcctgctgtctcatgtcgcgcttcctcctttttaagagcctttttttgtggcgggcttttccgtactgtacgacagaaaagaggtgagattgtccattttgattctcatttcctcctctgtcagcgaatggcataaaatatcatgcaaatggtcttcaaaattgctcactttgatttttgttaaaatgtcatctaattctccgacgacattttcaaataaatgaattttgtcatacagaagttttaagatatgctcttccaccgtatgttttgtcgccatattgtagatatggacatctctttcctgaccgagtctgtgaatccttccgattctttgttcaagccgcatcgggttccacgggaggtcataattgataatatggttgcagaattgtaggttgatcccttcgcctcctgcttctgtagcaatcagcacctgcactttgccgcggaagagatccttcatccagtctttttttccgcgtttaaatccgcctctgaacggaacggagcttatgccgttctgctgaaggaaccattgcaggtaaatctgtgtcgccctgtattcagtaaaaataatgactttatcattaatcttttggatcaagtcaacaacttgaatcgcttttgagttttgcgtgacttgattgatgcggtccattaaattagcgatcgtctgttcatcgaatgcgggcgcttgtttgtctttttggtcaagcatttttttgagcgtcatatacacggcttcccggcttgaacagcactctctttgcagcgtcataatggaaaatgcgcttgcgggcttttccgtgccgtttttcagtgcggcaatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcgtttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggggagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagctctcaacccttcaaattcaggaatggcaagggtctgctggacttcagccgacagtttgtacagctcccaatttgaccagggaccgtccgttttcagccgctcagaaaactctcccggccagtttgcatcaaatatgatctctgctgtcatttgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagaagcaggccaccaaaggggacgtctttatgatatgttcataaagtaaactttcaggtgccgggacagagaaaccttcattttcatgaggtgtttctctgtccttttttatatgtttttacaatgcgccaatgactgaagggggaagatgatgctgaaacgaacaccgctttatgacgtgtataaagaatacggcggaaaaacgattgattttggaggatgggagctgccggttcaattttcttctattaaagaggagcatgaagccgtccgcacaaaagcgggcctgtttgatgtgtctcatatgggggaagttgaagtatccggtaaagacgctctgtcttttctgcaaaaaatgatgacaaatgacgttgccgatttaaagccgggaaacgcgctttataccgccatgtgctatcctgacggcggtacggtcgatgatttgctgatctatcagaaaagcgagagctgctatctgctcgtgataaacgcgtctaatattgaaaaagacatcgcctggctgacggaacatgaggaaggcgacgtcacgctgacgaatcagtctgaccggatttcactgcttgccgttcaggggccgaatgctcagtcggttcttgcgaagctgactgaatgtgatttgtcctccttaaagccgtttgcatttattgacgaggcggacgttgccggacgccaagtcctgctttcaagaacgggctataccggtgaagacgggtttgagttatattgccgcaatgaagatgcggttcatctatttaaggagatacttgcagcgggagagcatgaaggcctcgttccgtgcggcctcggagcccgtgatacgctgagatttgaagcgaagcttgctttatacggtcaggaattgacgaaagatattacaccgattgaagccggaatcggatttgccgtgaaacacaagaaagattccgattttttcgggaaatctgtattgcgtgaacagaaagaaaaaggagccccgcgaaagctggtcggacttgagatgattgaaaaagggattccgagacacgggtacgccgtgaaaaaagacggtgttccgatcggggaagtcacgacaggtacgcaatctccgactttaaagaaaaatatcggtcttgccttaatcaaaacggaattcagtgaagtcggaacggaagtagaagtggaaatccgtaaaaaaacggtaagagcgaagattgtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaagatgtgaggtttcaaaaagactaccaaattaaaaaagcaaaatctgaaacggagctgacgagagagctgacaaagcttgcggcgaaaaataaggacgctgttacatatgcgtcttttctgggcgcaggagtgtacgatcactaccagccgatcatcgtcgatcatgtgatatcccgatcagagttttacacggcatatacgccttaccagcctgaaatctcacaaggggagctgcaggcgatttttgaatttcaaacaatgatctgtgaattaacgggaatggatatcgcaaactcctctatgtacgacgggggaacggcgcttgcggaagcggcgatgcttgcgtcgggacatacgaaaaagaaaaaaattgtcatttccgcagccgttcatccggaatcacgggatgttttgaaaacatacgcaaagggccaatatattgaggttgtagaggtgcccgcgaaaaacggcgtcacagatcttgaagcattggaacatgccgtttgtgatgagacggccgccgtgatcgttcagtatccgaacttcttcggacaaatcgagccgttaaaggacattgagccgctcgcacataaaggaaacagccagctgattgtttcttcaaacccgctcgcgctcggtattttgacaccgcccggggcatacggagctgatattgtcgtcggagacgcgcagcctttcggcatacctgcggcgttcggcggcccgcactgcggctattttgcagtaacgaaaaaactgatgagaaaggtgccgggccggcttgtcggccaaacagaggatgaaaacgggcgaagaggttttgttctcacccttcaggcgcgcgagcagcatatcagaagagacaaagccacgtctaacatttgttcaaatcaggcgctgaatgctttagcggcttcagtcgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgttaaggaagcaaaccggcggctcctgcaagacggcatcatcggcggatatgacttaggtcttgcgtatccggaactggatcagcatatgctgattgccgtcacagagctgagaacgaaagaagagatcgattcgcttattgcgggattgggggatcaacatgaataatcaagatcaggcgcttatttttgaaatgtcccgcgaagggcgtgtcggttacagccttccggagcttgatgtgccggaaacagagcttgaaagccttcttcccggtgactatatccgcgatgaagacgcaaagctgccggaagtatcagagctcgatattatgcggcattataccgctctttccaagaggaaccacggagttgattcaggcttttatccgctcggctcctgtacgatgaaatacaatccgaaattaaatgaaaagattgcccggttcgcaggtttttccgctattcatccgcttcaggacgaggacacggttcagggggcgcttgagcttttatacgatttaagcggacacttggaggagattacgggcatggacgaggtgacgctgcagcctgcggcgggcgctcacggcgaatggaccggcctgatgatgatccgcgcctaccacgaagcgcggggagacttcggacggacgaaggtgattgtccctgattcagcccacggtacgaatccggcatccgccacggtcgccggttttgaaacgattaccgttaagtcaaatgagcacgggctggttgacattgaagatttgaaaagagcggtaaacgaagaaacagcggcgctgatgctgacgaatccgaacaccctcgggttatttgaagaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggctcagggccggtcggagtgaaaaaagaattcattccgtatctgccgaaacccgttctcacgaaaaaagagggccgtttgacttttgattatgaccggccgcagtcgatcgggcgcgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtttgaccgtcattgcaagcatgaatttgtgttatcgggaagaaagcagaaaaagctcggcgtaagaacgcttgatattgccaaacggcttttggatttcggctatcatccgccgactgtgtattttcctctcaatgttgaagaaagcatcatgatcgaaccgacggaaacggaatcgaaggaaacgcttgatgcgtttatagatgccatgattcaaattgcgcgggaagcggaggaatcgcctgaaatcgttcaggaggcgccgcatacaacagttgtcaaaagaatggatgaaaccaaggcggcaagaaagccggttttaaaatacgaacgtacacctgacgtcagccgctgacacggtataaaaaaagagcttccgtataaaacggacagctcttttttcatgattagttttttgctttaatttttccgccccattttttaaatccgcctttcaggttgtaaatatctttgcagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatggccgccttcaaattcattcggttcacggacgtcaatcagctgcgcttttctgtagcccgcgcggaattcctcttccgtaagtgttttcattaaacgctgctggtaaaaatacgacacgatcatataaacgataaacgccgcaacaataattaaagcaatcatattagacaatgcgattctactcctttagcttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactgattttattaaaacgataaagaagggttcagtgtatggaaaaagaaacatggcggtttattgactcagggaatgaaagcccggcatttaacatggcgctggatgaagcgcttttatattggcacagccaaaagaaaattcctccggtgatccgattttacggctggaatccggcaactttgtctgtcgggtattttcaaaatattaagaaggaaattaactttgacgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacggagaaagaaaaagaaagcttgaaaaatccgcgctcgtccgtctgttttgatgccccttcgtggtatgagctggtcgtcgaaggacggaaagttgccggaagcgcacagacacgccaaaaaggcgtcattcttcagcacggttccatcctgcttgacattgatgaggataaactgtttgatctgtttttatatccgagcgacagagtccgtgagcgcatgcagcggaatttcaaaaacaaagcggtagccatcaacgccttagcgccgaaacgggtaacgatggatgaggccagaatcgcttttaaagccggttttgaggaagggctgaacattcatcttgagccttacacactcacgtctgaagagcttgcatttgtcaatgagctggctgagacgaaatacgcgtctgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccacccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggaggggggataaaaggggtggcgcttgccggcgcttatgaagcgctggaagaaaagggctttcgctttgaaaggctcgccggaacaagcgccggcgcgattattgccgcatttatcgctgcgggctatacgagcagagaggttcattccatcatagatgaggtggacggaaggcaattgcttgatcagagatgctcattcctcccgctgaaaatcctgcagtgggtgtcgatatattggcgcctcggactatacagaggcgatatgctggaaaagtggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagaccgaaaaaggcacctcaacggtcgttgacggcggcgtgttaagcaatttcccgatttggctgtattcaaaagaacgcaaacggccggtcatcggaatttcgctttcgcccaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtggtggcgacggagtttcatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttttgaaagcggttccgtcacggccggtgcgtcggttcaggaccgtcctcacgataaaataaataataatgcctgcgataataacggtgattgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggcttttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggagatattccgtactctgttcgtcagctggagcacttcaaaggagatgccgagaacgaccggtataagcgcaatcctgtctaaaatccgcacccaaagcggatctgtcggaacgagtaaatagacgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaatcagcttaaacagactttcgattccgatctgcgcggcgtctgaggaaaatacgggccttacaagctccgctaagaagaccgggacgagcgtaaaaacgaatttgctgaacaaaaacgacagaacgccgatcaccgccaggctgaaaaacatcgataagccggaacccttcttatcttcctgctccagcttggcgtcatcctgaggatcaagcccgtaacgttcgctggaaaagtttaaatgctttgtgccgttggcgctcgcctcaatgatggcgacgattccccgcaaaaaaggaatcttttttaaagccgaaagcttggcgttcggcactctcggaagcttgaaaaaatcaatgcttccgtcattcctgcggatggcggtaacataattttttctgccgccgaacattaccccttcaacgacagcctgcccgccgtatgcagggggcgttttttgtttggacattgtttatcaacctgcctgttttcttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaatttttgggcagtctatgactggaggtgccatgatgacaagcgaaaaacattcagaacaggaagaaaaaaagaagcaggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctgggcacgatggtcagcatcgttgtcatcggattcatttcaattgccggggcgtttatttatttcgtctgcctgaagcgttttaaaaccatgtggccggggatggtgtacggcgtcattttatggtgtgcggtttttttcttattcaatccgattttcgaagatgtgaaatccgtcactgaattgaaatcagatacaatcgtgacgacgctttgcctttacattctgtacggtttgtttgtcggctactcaatttccttcaactacaatgaacttacgtcagacaagcttgcaagggcgctcggcaacaagtgaataagtgtataatccctgtccggtatggtaaaatgttcacgagaagtgaacattttttatgctgaaaaccgggcggggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtatatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggatgccctgacgagggatcatatcaccgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagtcgggggcgcaagaatcgaagatgatatcatcatcactgaggacggcaaccggacaattacgcattcccctaaagaattaattattttgtgatcggaatataggaggacatcaaacatgatttcagttaacgattttcgtacaggactaacgattgaagtagacggcggcatttggcgcgtcgttgactttcagcacgtaaaaccgggaaaaggagcggcatttgtccgttctaaattgcgtaacctgcgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaataccttctggaaaatatgtctgtgcatatcatgatgtatcagtctgaaacgctcggtattgaactgccgaacacagttgaactgaaagttgttgaaacagagccgggaattaaaggcgacacggcgtcaggcggcacgaaacctgccaaaacggaaacaggccttgtcgtaaacgtaccgttcttcgtgaacgaaggcgatacgctggttgtaaatacatcagacggttcttacgtgtcaagagcgtagttaaagaaattcggagtctgctccttttacggggcaggcttttttttgcgttctgcctcagaatctttcttctatatgaaaatagtgagactacttccgtgagctagagcatatagtgtaacaaaatgcttgaagttgggggattgcaatgaaatttttgttcggttcaatcaattctactgttttaacgatggccggtttacgagttttgtcctcgctcattgaattatctgccgctattatcatgcttttgacaaacgacatcagaaaagcggttgtggtgaatagtattttggcaatcgtcggccctctgatctttatcatcacaatgacgatcggcatttatcagattgccggacagctctcatatgcaaaattaatattgatttttgcgggtgtggtgctgattttggccggtgtgcataaatagagggccggggtgtcataaagtctgtcccggatcatacattttaaagaagccaatcggtaaaaaggaggggactctattgaatgaaattacagaggttctccctgaattattgagagatgccatctccgccgtgcccgaagaagcaaggcgggatacagaagaaatcagaatccgggtcgacaggccggttgaactgatccaaaaaggacaacctttgtatttgtcatatgtgtgtacggccggcgacgcacagctgatcctcagccggctcagcaactacagtatgtacacgctggaagaagagctgaaaaaaggatacatcacaatcagaggaggccaccgtgtggggctggccggaagagtcatcgtcgaaaacggagccgtcaaaggactccgggatattacttcttttaatatccgaatcgcccgggagaagctggggatcgcagaaccgctcattcctttcttatggaaagaaaactggctgaacacgctgatcatcggtcctccgcaaacggggaaaacgaccttgcttcgtgatttggcccggctttccagcaccggatcaaaacgcattccggcaaaaaagacaggtatcgtagatgaacggtcggaaattgccggctgcctgcggggcattccccagcacagtttcggccgcagagtcgatgtccttgatgcctgtccgaaggcggaagggctgatgatgatgatccgttctatgagtcctgatgtcataattgtggatgaaatcgggagaatggaagactcacaagcgctgctggaggcgctccatgcgggcgtatccgttatcgtctctgcgcacggatggaatatgaaagacttggtcaagaggccgtcgctgaaaatgctttgggaggaaaacgtgtttgaccggtatgttgaactgtcaagacgccgcggtccgggaacgatcagcaggatgtacggaaaggacgggaaacctgttccgcatgctgaaagcgtgatgacatgctgaagcttttgggtgccgtgttcattctgacagcgacgacatggacgggatttgagatcgccaaaatgtatattgaaaggccgagacagatccgtcagctgcgcgcggcgctgcaatcgcttgaagcggaaatcatgttcgggcatacgccgctgcacatagcttcgggacaaatcgccgcacagctttccaagcctgtatcatcattgtttcaagctttcagcaggaggcttgagcagggaagcgattccgccaaaacggcctgggaacagagcttgaaacataactggcccttcatggcgatgaaaaaaagcgaatacgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgaccaaatgggaaaaaaagaatacgcccaatgggtgacgctgcttggctttatctatattttatttatggtggcgacgattgtcgatgacctgttcaaaaagatcaaagctgtgtttctattccaaggataggggggcttacagattgagattgttcaaattgtaggtttaggcctgatcgccacatttctctccctgatcgtaaaagaacagaaaccgactttcgcgtttatgattgtcgtcttcagcggctgcgtgatctttctctatctcatcgatcagatttacgacattatcagaatgatagaaaaaatagccgtcaatgcaaatgtcaatatggtctatgtggaaaccattttaaaaattatcggcatcgcctacatcgctgaattcggtgcgcagctgacaaaggatgcgggccagggagcgattgcttcgaaaatagagctggccggaaaaattttgatactggtaatggccgtgccgatactcaccgtcattattgaaacgattctcggacttattccttcttgatcatcaataaaatggaaaggggggcacaaaaaatgaagcgctttcggtgggcgggggcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcatcgactttattaacggtgaaaaaacgttctcgccggaggcatggctgaaggctttattttcatacttgtttcatgaagtgctcgcaaacggaaagcttctgggaactttgattcttctcaccattttttgtgtcattctgcagcttttgcaaaatgcgtttcagcagagcactgtcagcaaagtggcttatgcaatcgtctacatggtgctgattattctcgctttaaacagctttcatgttgccgtcaattatgccagtgaagcgatccagacgatgacaagtttcattctcgcgctcatcccgcttttactcgcgcttttggcgtcttccgggggagccgtctccgcagctttttttcaccccgttattttatttctgatgaatacgagcggccttctcattcaaaacattgtcatgccgcttattttcctgtctgcgattttaagcatcgtcagcacgatgacggatcaatataaagtcacgcagcttgccaatctgctcagaaatatcgcgatcggcgcgcttgccgtatttctcaccgtgtttctcggcgtcatctccgtacagggggcttcggctgccgtgacggacgggattacgctcaggactgcaaaatttatcacaggcaattttattcccgtgctcggccggatgtttacggatgcgacggatacggtcatcagcgcatcgctcctattaaaaaacaccgtgggaatcctaggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagcagaagcgtgctgtatattttcgcggcgctcgccatcgtctctctcatgtttttcctcagcattacagtcattattacagcaggcaacctcaccatgatgatgaaataaaggaggcctattggatatgagctttttaacagaatggctgacaagcattattttgtttatcttattcgccatcgtcatcgacatgctgctgcccagctccagtatgcaaaaatacgccaagatggttgtcagcctgctgttaatcattgtcatgctcaacccgatcttcaaacttttcaaaacagacccggaaatcatcttcgattatttgacaaaacaagagcaatctcaatccgctgatataaaaaatcaaatcaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgaaaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattattttctgttcgtgtttgtgctcggggtatcttttatgctggtgagccagctgttctcttcaccggagaaaaccgggaaggaccaagcggcgcagaccgtcatgtccggccgaacggaagacaaaagcgggcaaaaaagcgcacccgtttttaaggcatcgaaagacagcagcgccaaaaacacgatcgatgattatgaaagagactatgaaaaccagctgaaagaaatccttgaaacgattatcggcgtggaggatgtatcaattgtcgtgaacgtagacgcaacatctttaaaagtgtttgagaaaaataaaacgaaaaaagacaccaccaccgaagaaaccgataaagaaggcggcaaaagaagcgtaaccgatcaaacctcagaggagcaaattgtcatgattcgaaacggggatcaggaaaccccggtcgtcgtccagacgaaaaagcccgatatccgcggtgtactcgttgtcgctcagggagtggacaacgttcaaataaaaaaaaccatcattgatgccgtcacaagggtgcttgatgttccgagctaccgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtggcaactgaaaaaacgccggctcctgaaacgaaagataagaacggaagcggcacggataaagaagacggaacaaaaggaacgaaagattctaaaggcacaaaagaggataaagaaacatcagctgaagcatcggacaaagacggatcggtcgctacagaaacagctgatgaaaacttatttaccgcataccgcatggagcttgaagacgcgagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattacggtcatgtctgacaaacattcaaacgcaaaagcttccgctatcattgaccttgtaaaaaaagaaatcaagacgatgaaagacgtcgccattacgtttgaaccgacaaaataagagatctccaccgcccgcacctgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaattcgtttacgaaatcgaaggcgtaagcctcaaactgaaaaaaaatgaagcgccggcagtgaatgtaacgggacaagctcaagccgttcccgccgcttacgcacctgctccgcaggctgcaaaaccggaagcgcatgaagccgctcctgttcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaggaattgaacgtaacgtttgtcggccctacggctgacgccatttcaaaaatgggaacaaaagatatcgcgcgcgacacgatgcagctggcgggtgtgccgattgtgcccggttcaaaaggaatcataaaaaataccgaagaagcggtttcgcttgcaggtgaaattgggtatcctgtgattataaaagccactgcgggcggaggcggaaaaggcatccgggtcgcacgcacagaagaagaactgatcaaaggcattgagattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggcgaagctgcggtaaaagcagcgaaggccgtcggttacacgggagccggcacagtagaattcatttatgactacagagaacagcgctactacttcatggaaatgaacacgcgtattcaagtagagcaccctgtcacagaaatggtgacgggaacggatctgatcaaagaacagatcaaagtggcatccggacaggagctttcgctcagacaggaagacgttgaatttaacggctgggcgattgaatgccgcatcaatgctgaaaatcctgcgaaaaacttcatgccttcacccggtaaaattaacatgtacctgccgccgggcggactcggcgtacgcgtggattcagccgcatatcccggctattcgatcccgccgtactatgacagtatgattgctaaagtcatcacatacggaacaacgcgtgatgaggcagtcgcacggatgaaacgcgcgctgagcgaattcgtgattgaaggtattgaaacgactattccgttccatctgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgacgaggctcatttaggcaaggttgaaattgctcctgaggtcattgaagtcattgccggcatcgccgcttccgaagttgaaggagttgctgaaatgcgcggcaatttcgccaccggcgtcgtagaacgcttcggcaaaatcaatcacggtaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatacggtttgtgaaaatattcggcattagggtgaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgaggccattgagcacgcgcttgatggtgaaaaaacagatgccttctttgaacagctggtgtacggagtgatcgaacttcaggttcagcttgatgaaatgatttccggccatctcgtcaattggaagcttgaccggattgcaaacgtagaccgcgcgatcctgcgtctggcggtgtatgaaatggtttatactgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcccggtttggcggtcattttaatcggagacgatcccgcttctgtttcatatgtgacaggcaagaaaaaagccgctgaaacaatgggaatgaaatttaaacttgaccgctttgactcaagcttaaccgaggcggagcttttaacagtgattgatcagtataatcaaaatccggaattccacggcattctcgtccagctgccgcttccggatcatatttctgaaaaagccgtaatcgagcggatctctcccgataaggatgttgacggtttccaccctctcaacgtcgggaaaatgctgcttggcgaagatacatttctaccatgcacgccgcacggaattgtcgagttattgaaaaagacgaacgtagatctttccggcaaagaagttgttgtagtcggacgaagcaatattgtcggtaaaccggtcggccagctgctgctgaacgaaaacgcgaccgtcacatattgccattcccgtacgaaaaatatgtctgagcatacgaaaaaagcagatattcttgtggtagcggtcggtaaagcgaatttcatcaaagccgatcaaatcaaagagggcgccattgtcattgatgtcggcgtcaaccgtctcgaaagcggaaaactctgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcaaagacaaagttcgaggcttgcgtttaagcccgaggacggaatgaaggtcatcgtaagaggcggcatttccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggccacgatcggggtcgtcacgtcaccgacgggagcagccgtcagagacgtcattaccacactcaaaagaagatacccccttgtgaaagtcattgtgcttcccgcgctcgttcaaggtgaaaatgccagcagatcaattgtgaagcgcattgaagaagccaatgcacaaaaaatgtgtgacgtcctgatcgtcggaaggggagggggctcgatcgaagaattgtgggcatttaacgaagaaatcgtggcccgggcgatttttgcttccgtcattccgattatatcagccgtcggacatgaaacggattttacaatcagtgatttcgtcgcggatatccgggcggcaacgccgacaggagcggcagaaatcgccgtcccgcacacgacggacttaatggaacggacaaaaacggcggaagtccgcctgacaagagcgatgcagcagcatatcagcaagaaaaaagaacgggttcaatcgctccagtcatcctacgcgttccgttttccgaaacgattgtatacccaaaaggaacagcagtttgatcttttgtatcagcagttccaatcacagctcacagggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccccttcaggtgatggagagaggatacagtctggcctataaagataaagagctgatcaaaagcgttgatcaagtggaacaaaatgatacgcttgaagtaaagatgacagacggcgttctgacgtgtgaagtattgcaaaagagaggcgaacgaaaatgacagaaaccaaaaaaagtgaagagctgacatttgaagaggcgatgaaaggccttgaaggcattgtggcaaagcttgaagaaggagacgtgccgcttgagcaggcgattaattattttcaggaagggatggccctttcaaaaatgtgccatgaaaagcttcagcatgtcgaaaagcaaatggactttattttaaaagataacggcgaacttgcacctttcagcgttcaggaggaagacgaaggtgacaaataaactggacgcatttttagcatcgcgcaaaaaactgattgaacagcagctttctttgtatacggaacggcttgcgatgcctgaaatcctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattccttaatccatgatgatcttccttgcatggacgatgatgatctgcgccggggaaagcccacaaaccataaagtcttcggagaagcggcagccgtattggccggagacgggcttctgacagaaagctttaaattgatcacatcccacgtgtctgaggcggtttcagcagaaaaacggctccgtctcgtcgatgagctgatcagcgcggcaggaacggaaggaatggtcggcgggcaggctgccgacatggaagcggaacaaaagcggataacgcttgaggagctggaatccatccacgagcggaaaacggccaagctcctcggtttttctgtgacggcgggcgccattttggcagatgcgccggaggatgaagtcgaaaagctgcgtctgttcagcagccatatcggcatcggatttcaaatcagagatgacatccttgatattgaagggcatgaggagaagatcggcaaaccggtcggctcagacacgtcgaatgaaaagtcaacgtatccgtcgcttttaacgcttgaaggcgcgaaagagaagctggcgtatcatatcagcgaggcgaaacggatcatcagcggcctttctcttcagaaagaactgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggaaatccgcaatttcctcatcacatcgctgtctgcctctggcggccatatcgggccgaacctcggggttgtcgagctgacaattgcgcttcacaaagaatttgacagtccgaaagataaatttttatgggatgtcggacatcagtcctatgttcataaactgttaaccgggcgcggcaaggagtttgaaaccttgcgccaatataaagggctttgcggtttcccgaagcgcagcgaaagcgaacatgacgtatgggaaacaggccacagctcaacatcgctctcaggcgcgatgggaatggcagccgcccgtgatattaaaggatcgaaagaatatatcatcccgattatcggagacggcgctttaaccggaggaatggcgctcgaagcgctgaaccatatcggtgatgagaaaaaagatatgatcgtcatcctgaatgataatgagatgagcattgcgccgaatgtcggggcgattcattctatgctgggacggcttcgcacggccggcaaatatcaatgggtaaaagacgagcttgaatatttatttaagcgcatcccggccgtcggcggaaaattggccgccacagcggaacggataaaagacagcttaaaatatatgcttgtgtcaggcatgttttttgaagagctgggctttacgtatttaggccctgttgacggtcattcctaccatgaactgtttgaaaacctgcaatacgccaaaaaaacgaaaggtcctgtccttttgcatgtcattacgaaaaagggcaaaggctataaaccggctgagaccgacacaatcggcacatggcacggaacgggtccttataaaatcaatacgggtgatttcgtcaagccgaaagccgcggcgccttcatggagcggacttgtcagcggcaccgtgcaggagctggcgcgcgaggatgacagaattgtcgcgattacaccggctatgccggtcggctctaagcttgaaggatttgcgaaagaatttcctgagcgcatgtttgacgtcggaatcgcagaacagcatgcggcgacaatggccgcgggaatggcgcttcagggtatgaagccgtttcttgcgatttattcgacctttttgcagcgggcgtacgatcaggtcgtccatgatatctgccgtcaaaacgcgaatgtatttatcggcattgaccgcgccggtttggtcggcgctgacggggagacgcatcaaggcgtctttgacatcgcctttttgcggcatataccgaacctcgttttaatgatgccgaaggatgaaaatgaaggccgccatatggtcaatacagcccttaattatgaggacggtccgattgcgatgcgcttcccgcgcggaaacgggctcggcgtaaagatggataaagagctgaaaaccatcccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgaggttcataaaaccgattgataaacaaatgatgaaggccgttcttaatgaaggtctgccgattttaacgatagaagaagccgtgcttgaaggcggattcggcagcacgattcttgaatacgctcatgacctcggcatgtatcatacaccgattgacagaatgggcatcccagaccggtttattgaacacggcagcgtaaccgccctgcttgaagaaatcggtctcacgaaggctgaggttatgaatcggataaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaaacttgaaaaagccttggaagtgtttcctgtctcggtaaaaggcaaaacgatgattgacatcggctcttctacagggggattcacggattgcgccctccaaaacggagctgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggcgttcatgctgacgttctccgccgcatgaatcaatttgcagcttctgaaggatatacagtgaaaggactgtccttctcaccgattacggggggagacggcaatattgagtttctgcttcatttggaatggggcggagaagacggaaacggcgctgaactgccggaagaagacattctccgtaccgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaacccaggcgactgtctccagagacattaaagagctgcatctcgtaaaggtgccgacgaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctttgatggataatctcgaatgggaagaaatcatgggcacgatctgcggagatgacacgatcttaatcatctgcaggacgcctgaagatacggaaggcgtacaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggacgcggctcgtccgaatttgtccgttacggtgaaacaaaggccgagcttgaaggactgtttctattggacagcggtcatcccgtttttgaagtatgccgtgagcagggaatagacgcatctgatgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggcgctgaggccgaatccgcgcttcaggcttaccatgaaggctatgagcgttatatgaagctgctcaaaaaagtgaagaagctgtcagaaagcgagcaggaaatggcgcatcggttagacctgattcaatttcagcttgaagaaatcgagtcggcgaagcttgaattgaatgaagacgaacttcttcaggaagagcggaagcagatatccaactttgaaaaaatttatgaatcattgcaaaacgcctacaatgcgctccgcagcgagcagggggggcttgactgggtcggaatggcctctgcccagcttgaagatatttcggatatcaatgaaccgctgcaaaagctgtctgaaagtgtgtcaagttcctattatctgcttgaggatgcaacctttcaaatgcgcaatctgttagatgatctggaatatgacccggaacggctgaattttattgaaacccgtttaaatgagatcaaacagctgaagcgcaaatacggagcgacggtagaagacattttggaatacggctctaaaatagaagaggaaatcgatcaaatcgagaaccgcgacagccaccttgaagccctgaagaaggaattggagtcggtcggcaaagatgtggccgtagaagccgccaatttatcaaaaatcagaaaagcatgggccaagaaactggcggaagcgattcatcaggaattacaaagtctgtatatgggcaaatcaacgtttgatacggaatttctcgtgaaaaccgatccgtcagccagtgaagcaccggttgttaacgggcagcccgtgcagcttacccaaaaggggatcgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggacggacgacaacgcatgtcacgccgctttccaagcaggataaggtagcggaaatcggccgcatgattgcgggtgttgaagtgaccgatctgacaaaacggcatgcacaagagcttttaaaacaggccggacaggtaaaaacgacaggataagctgctgatacaggcagcttatttttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccgtttaaagaatatttactgataccgtcagaaatgagcgtctttgaaaaccagacacaggccgttgcggtcaatgcatcaataagcgctgaaaagggcgaattatcagaagcctttacgctgaaagaagagcacggtcatgcaaacataacagggcaaacacaaggccggtcagaagtagtatatgatcttgccgggtttcccattaaaaaaacgaaagtgcgtgtccttcctgaattgaaggtcattccgggcggacagtccatcggtgtaaaactgcattcagtcggtgttttggtcgtcggttttcaccaggtgatgacaaaggatgggaaaaagtctccgggagaacaagcgggtattgaatctggcgacatcattattaaaatgaacggacataaaattgaaaaaatgagcgacatcgccccgtttattcaaaaagcgggcaaaaccggtgaatctttggatttattggtgaaacgcgataagcaaaaaatcaaaacaaagctgattccgacaaaggacgaagccgaggggaaatatcgaatcggcctttatatccgcgattcggcagccggcatcggcaccatgacattttttgaaccgaaaacaaaaaaatacggcgcattgggccacgtcatctctgatatggatacaaaaaaaccgattgttgtagaagacggagaaatcgtccgttctactgtaacatcgattgaaaaaggaaaaggcggcaatcccggcgaaaaactggcaaggttttcgtcagaacggaaaacgatcggcgatattaaccgcaacagcccgttcggcatttttgggacactgcatcagccgattaaaaacaacatttctgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtgttgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctatggcgtccatatcgaatggatgctgtctgaagcgggtgttgatgtttacgggaaagacaaagcaagctgactgccggatgatccggcagtttttttatgtgatgcgttcttcacttctttccgggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatatagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatcccgatgtgctcgtgttagacattatcatgccgcatctggacggacttgcggttttggagcgtctgcgtgaatcagagctcgagaagcagccgaacgtcatcatgctgacggcattcggtcaggaagacgttacgaaaaaagccgtcgatttaggcgcatcctatttcatcctgaagccgtttgatatggaaaaccttgtcggccatatccgccaggtaagcggaaatgtcagcagtgtcacacaccgtgccccgtctgcgcaaagcagcattatccgcagccagccggagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaaaccaaccaactcggaattcatcgcgatggttgctgacaagctgagattggagcataaagcttcgtaacgcaagcctttggctaaatgtctttttgcgccttctattccgtgcatgaacgcggaagagaaggcgttttgagattttgctgacgaaaacaatggaaaccactcacgccggtacttgttctatacataaatacgggaactatgccgtctatacgtataataccggagctgatattttaatgattttgccgtctctgaaataaaagcgggggatgcggcggcttaacacagacaggacttcgtagctgatcgtaccgagcatttcggcaatttcatcaacggaaatctcggcttctttttgtttgccgtagatgacgacttcttctccttgtttgccctcattctcacctaaactgaccattatcatatccattgtcactctccccgccaccggcacccgtctgccgcggtgcagaataaacccgcggttggacagggcgcgggagtaaccgtcagcatagccgatcggaatcgtcgcgatgatttcacccggttcggcgatatatgtggcgccataactgacggtccggggatctgtcaccatagctttcacataagcgatacgcgcctttaaacttagtgcgggtgtgagatccacgaggttcagttcctttatcgaggcggacggatataaaccatataacccaatacctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacaggtatgtactcgacttgagcgctttcaccactgctaaaagatcttcttctgtgcgcacacccagccggcccattccggtatccacattgatatgaatggacagccgtttcgactctgcttctttttccaatatccgattcgcttttttgatccagctgtcctgaaacgctgataatgtgatgttccaaacggcagattttttcacacagctgagagctgtgaagccgagcacaagaataggcgccttaattcccgctctccgtaacacaattccctcttcgacgctggcgacagcaagctcgctcgccccgctttccagtgcctgccgcgctacttccacagagccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagattcagtactcatgctttcaatctgcattctattcatctttaactgaaatcattcaaaacatggaaaggtgatcgttgatgtttaatatcaagttttcggggaatcagtgtgcctgctttatttatgcagtaagggcagcatggcggcccttacaatgactttacaatattctgatctgaaaattgatgttcaaacattttggactggcttacagcattgttttgaatgacaatgccgatatttccccctccggcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatatcataatgttttcgttacattttgatcagagtattgagagtttgaagattgagatgtgctggattgattcatttgcaggaccatacctgtatttccccctcctgagccgtagacggtttttgatacggttaaaggacttatcgaaaacgcaccgccgatattgacaaccccgtttccggaaagactgttaatcgtaatagggaaaccagccatcatatacggtctcctttctattaatctatttactatatgtacgctgtgtgttagaaataggagtaaacaaagcggtaaaaacttgtgaatcaaaaaaactgccggacatccggcagttttttagtctacttttcaaacggcacccagccgcctgtattctgaatcatttcccataacggttcaggaagtcggtatttctcgatttcagatgcctgaatggctttttcgatttcctgttcgcggccttctttgaccagcaccgcccattcggggttaatcaaaatgacacgtcccagagccaccagcggaattccgctttctaatacggcaagcgcttcgtccgcggtatagatggaaccgacggccatcagcggcactttatggccgatgcgttcgtttaataaatccatccgggtccgtgaagtatccgcgccgcggcgggctttggaattgacatccatcagtgaaatatgcagataatccaagttctcttctgcaagcgcgtcggcgagcatgaatgtttctttcattgtaagccccggtgtttccggctcttccggtgacaggcggtagccgagaacgaatggattttcagcgtgtgtatcaatcgcctgtttgacagcgtcaacgactgcaagcgggaacgcaaggcgcttttcatcgcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttctgtgagagcacgggacgtttgtctgccgtcttcttctgagccgctcggactgacgacgtcgttgtttggcacgagttcaggagggcattccaagcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgctgtaatgaccatgcccatttcttttgaacggggagtaatgtagcttaattcacggtcggaaatcgttccgtcatcatttgatgaatagtgtgtcatcggtgcgactgaaatacggtttggtatagtgacaccgctttcgaacgtaaaaggttcaaacagcggtttaaaagtttgcttcatcatttcgccttcttccttaggagtttaactcgtccgtattctagcttatgttttcattgtgtgcaattattttgcttgttcttcttcctgaggttatgaccggctgaaccatttaaacgaatgaaacggttttctccgttccttttcaggatctttatatcctcctgaaatttgatggccgatcgagctgaatatgacagcggcggcgaagaggagaatgatttttttcatatgcatatcttctttcttatcttttacatggttatttataagcatacgcttgtgcgaaaaaaccgtcaatttgtttattcttttttccactttcctgcggcgaatatcgttccgatctgaatcacaacacttaacagagcgcacactgccacaactgtgttgctgtccatagaagacaccctcctttttgttaggttgatgtatcatatgacggctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccgggataacgtcggtcgctaaaatataatacagcagcgcgctcccgagaatcgcgcggtcttcagccggtgttgattcatccatatactgatgatgcatgtttttcaaatggtcaataaaagggccgacgctttcttcattgtccattttcttttgaaactcatcgcaaatcaggcgatggccctgctgggttttggtgtattgttcatatctggtcagttcacgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggaggtgttttgaaaattcctgaagatgctttaaattggccttctgtttgccgttgataatccgggagatagtggccgtatcaatgtttgttaaggcgccgagttttctcatggagagcgagtgcttatcaagcagtgattttaaaaggggtcccagtgtcttatttttattttctgtcaagggtgtcacctcgtttccgccggaatgatgatcgtcaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcaagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgttttaccgggctttcttcctgtattgctggcggcgtttattttatctgtcatcggtatccgcatcattctgctggctgtgccgagaaaaacagcgcgtgttggcgcgtcaggaaaaaaaggccgttttgccggtctgctgcaaaatccggaggcagcggatgccgacggttcgggagaaatcggtatattggaatccttggttctcggggtggccgtatccgcaaatgcgctgaccaacggattaagcgcggggttgatcgggctttctcccgctgccatttccattactgcggcggtcggaagctttctgaccatatggatcggctgctcgcttggaaaaaaagccgcttcattgcgcatcggttcttttcacgtcggacagttcagcacggtgctgagcggagtgattattctcatcattgccgccaatacgctgctcttttaagttgtcccgttcattttatgaaaagctcaaaataaatatgaatgtttctattcgggagagtgcatgacgcggctctcttttttgccgatctgatattttttcaaaatgaacagaaagtcgtccgtttccgttaaattctgcatattcggccttcagacagaacctttttcatagactgatcagcttgttttctttctaagttcaggtaaacagcaggtcagatagccttcattccaaagatggaaaaacgctggaggaatggaggccccctttacaaatcggccattctgttcaaagataaagccgaatgagaaaacgtgaggtgatctgtgtgaagtctgccatacttctgatcttcaccgcatggctgttatcaggctgcgagtataccgcggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtcgctgcctgaacatacggcggtgcaaatcacctataaaaaagagagcaacggacaattacggcttgagaaactgaaaaaagaaacagatatgtgaaaacggggaggaaaaaaacgtgggtttactgacaaaaagcgctgctgccttcggtgccgctctgcttctgcttgcgccgtccgcttatgcagccgaacctttgcaagggaaaaccatctatatcgatgccggacatggcggagaagacagcggggccggcggaaatggactgcttgagaaaaacatcaatttagcggtgtcaaacaaggtgatcgccaaattggagacagaaggcgcaaaacctgtagcttcaaggactgacgatacttttttacgtttggacgagcgggtggcgaaagcgagcgccagccaatccgatttattcgtcagcctccataccaattcagccgtatcaacggcatcgggcacggaaacgtattttaattcgacatatgaaggagcggacagcgaaaggcttgcttccgacattcagcagcagcttgtcacgtctttagggatgagggacagaggcgtaaaagaagctcctttttatgttattacatattcaaagatgccgagtgtgctggctgaattaggttttatcacaaatcctcaagatgcggacaagctgaaaagcgataacggacaagagcacgccgcggacgccgttgtaaacggaatcgaaacctattacagcggacggtaatgataaaatatgtgtaaatagcgccctcctgatgtgcataacgattataatagagaaaaccgatgacaaacatctgaggtgacacatatgacgaatatttttgcccaccggggggcgtcgggcgactgccctgaaaatacgatgcccgcattcaaaaaagcgattgaggacggggccgacggaattgaacttgatgtacagatgacaaaagacggccggatcgtggtcattcacgatgaaaccctcgaccgcacgacatctttgaaaggatttgtgaaagatacggcgtatgacaaaatcagaaccgccgatgccgccggaaaatggaaagattcttttaaaggtgtcagaattccgcttttgtcagatgtgctgcgttttgcggaacgtgctgattttctgataaacattgagctgaaaaacagtgtattccgttacgaaggaatggaagaagaagtgatcaaaaaagtcagatattacggactggaaaagcgcgttattttttcttcatttaatcatgagagtctcgcggtgtgccacgccctggcgcctgaaattgaacgggcggtgctgacaatggatgtgctgtaccggcctgaacggtatcttgccgccattcccgcttcgggttatcatccgaagctcggcacgccggcggtcagcgctgaagtgatcacacatcttgcaaaacaccaagcggcgctccgtccgttcaccgtcaatcgtcctgaggatatgaagcggctgatgaaagcggggatagacgcaatttttaccgactatccaaagctggctgtttctataaaagaagaatgccgcagctgagaagactggtcagacagtcttctttttttatgggcgggaaaaaggcggtgcactcataactcggtcagccggttcatatattgtaacagggcgttttgtgtaagcgttatcttttatcttattgaaagtgaggcaaaattgtgggaaaaacggttatcgtcagtgcggcaagaacgccgttcggaaaattcggcggcgcattaaaagaggtaaaggcagccgagcttggcggcattgccataaaagaagcaatcaagcgcgcagctatcagtgaaagcgaagcggaaggagcggtgatggggatggtcgtccaggcgggtgccgggcagattccggcacggcaggctgcaagatatgccgggcttccgtggtctgttccggctgaaaccattaataaggtctgtgcatcagggctcagggccgttaccatctgtgatcaaatgatccgggcgaaagatgcggacgtgctgattgcaggcggaatggaaagcatgagcaacatcccgtacgccattccggccggccgctggggtgtgaggatgggggacggggtttttcaggatttaatggttcatgacgggctgacctgtgcgttcgaccaggtgcatatggctgtccacggaagcactgcagccaaaaagtatggcatttcccgggatgaacaggatcattacgctcttttgagtcagaaacgcgcggctgaggcggctgagacgggcaaattgcgtgaagaaattgtccccgtcacctggaccggcaaaaagggcaaacagcatatcgttgaagcggatgaggggctgcgtcctgatacaagccttgagcagctcgcagcgctcaagccgattttcacagccgacggaacggttacagccggaaacgctcccggtgtaaatgacggggccggagcatttgtgctgatgtcagaggaaaaagcagcaaagcagcatgtcaggccgctcgcagcgatacttggctttgcgtcagtcggactggaagcgtccgagctggcaagcgcgccgggagaggccatcagccggctcttgaaaaaaaccggactgtccgttgacgatattgatttgtttgaagtaaatgaagcatttgcgtccgtcgtgctcgtgagtgaaaaaatagccgggttcagccgggagaaagtgaatgtaaacggaggggcaatcgcgttcggccacccgatcggcgcaagcggagcgagaatcgtcatgagtttaatatacgaattaaagcgtcgcggaggggggttaggcatagcggctatatgcagcggagcggctcaaggagatgccgtcctgctggaggtgtactgatcaaaggagggagcgccggatgaagatgaaaacaatcatggtcgcaggtgccggtcagatgggagcaggcatcgctcagacggccgcagaagccgggtttaccgtcaagttatacgattgggagccggaaacggtaacaaaaggtcttcaccgcataaagacaaacctggagaaagagcaggcaaaaggacggaagtcacagcaggagacagatgccgttttcagccgtatttccccggcggagctcacagaagcgggagatgctgattttatcattgaagccattgccgaaaacaaaaaagcaaaagcggaattgtttgacacacttgataaaatctgtccccctcatgccgtattggcaagcaatacgtcttctcttcctattacggagcttgccgcggccacaaaaaggcctgaaaaagtaatcggcatgcattttatgaatccggttccggtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagcgattgatgaggtgatgaagctcggcatgcgtcatccgatgggtcctttaacattagctgacttcatcgggctggatacgtgcctttccattatggaggttctctacgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttactgaagagcacatcatgatgaggaaaatggtgcgtgattttgcccgcaaggaaatcgcgccggtggttgagctcatggaatcaacagatgaatttccggagcggctgattaaaaaaatgggcgaagcgggattgatgggcattcccgtcccggaagcttacggcggggcgggtgctgatacaacatcttacattttagcgattcatgaaatatcaaaagtcagcgcggccgtcggcgtcattttgtccgtccacacatcggtagggacaatcccgattttgcatttcgggacagaagcccaaaaacaaacgtatattccgaagctggcagcgggtgaatatattggagcttttgcgcttactgagcctcactccggatctgatgcgggaagcctgaaaacaacagccgtgcgaaaaggcggttcatatattctgaacggttcaaaaatctttattacaaacggcggagcggcagatctgtatctgacatttgccataaccgatccgggtaaagggagaaagggaatttcagcgtttattgttgaaaaaaacacacccggtttttctgtcggaaaaaaagaaaaaaagctcggattgttaggttccaatactgccgaattgcagtttgatcaagcggaaattccgattgaaaaccggctcggcgaagagggcgagggtttttcaatcgccatgaaaaaccttgacgtcggacggatcggcatagcggctcaggcgctcgggattatcgaagcggcgctcggctgctcggcggagtacgccaaaacccgcagccagttcggcagacccatcgcttcgaatcaggccgtttcctttaaattatctgacatggcaacgaatgcggaagctgccaaattattggtctatcatgcggctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaaccatggaatcttattctcccggtttagatggcgtcattgcggtggaaacggggatttctttcctggatacacagcagggcagtattttaatcaaaggccacgatctgattgagctttctaaaacggccggctatatggacattgttcatctcttattggaagacagacttcctgatgcgaaagagaagaaggcgcttgaagaagacgttcggcgcggcggacaccttcccgaggaaatcttgcgtatatgccgtctgctgcccgaacgtactcacccgatggacggactgaggacaggtttgtccgcgcttggaggctttgataaggatattgataaccgcacctcttctgtaaatcggcaccgtgtccgcgggctgataggcaaaatgcccaatctgaccgtcaacagctatcgagtcatcaacggactggagcctttagcgcctgtcggaaccttatcgtacagcgcaaactttttatatatgattaccggaaaaacgccgtcctccttggaagaagaaatattcgaccggtcgcttcttttatacagtgagcatgaattgccgaactcaacgtttacggcccgtgtcattgcttcgacgcaatcggatatttacggcgctctgaccggagccgtcgcctcgcttaagggaaaccttcacggcggagcgaatgaagcagttatgtacatgcttgaggaagcgaaggatacagacgggtttacacaattattaactcaaaaactcgcaaacaaagaaaaaatcatgggcttcggccaccgtgtctacatgaaaaaaatggacccgagggcgctcatgatgaaagaagcattgaaaaaactgtctgatctttcaggtgatttccgtctttatcatatgtgtgaagcaggagaaaccgtcatgagagagaaaaaaggcctttatccgaacttagattactacgcagcgccggtctattacatgctcggcatcccgatcccgctgtatacgcctatattcttcagcgcacgaacggtcgggctgtgcgcccacgtcattgaacagcacagccgaaaccggcttttccgcccgcgtgtccgctataccggagcgcgtctgtaaacagatgagaaaggaagatgaaaacatgacagaaccccgccgaatggacgccgtaatcgaagagatttctgactacgtgctccatcaggaaattgacagttcggaagctttcactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcctttaatatcggctgtatcaacaggtggctcgattataatgatacgtggcttgcggccgaatgggggcatccgtctgacaatctcggaggcatattggcttgtgcggattatatatccagagtgcggatttcagaagggaaagaaccgcttaccgtgcgtgatgtgctttgcgcaatgatcaaagcgcacgaaattcaaggaattctcgctttggaaaacagtttaaacagagtcgggcttgaccatgtgctgtttgtgaaggtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatatttggcccttatggcgcaaaaaggtgagatggggtacccgacggctctgaccgcatccgggtggggatttcaagacgtattatttaaccggcaggaaatgaagcttgcccgcccgcttgggtcctatgtgatggagaatgttttgtttaaagtatcctacccggctgaattccacgcccagacagcggcggaatgcgcggtccggcttcatccggaggtgaaataccgcatcgaagacattgacaggatcacgattatgacccatgagtcggcaatccggattatcgataaaaaagggccgcttcacaatccggctgaccgggatcactgcctccagtatattacggcaatcgggctgcttttcggagatatcacggcggatcattatgaagaggaaacggcgtctgacccgcgaattgatacattgcggagcaaaatggaggtgacggaacataaagcgtactcagaagattacttagacccgaataagcgatccatctcaaatgccgtacaggtgcattttacagacggcacggctacgggacggattgaatgtgaatatccactcgggcaccggttccgcagaaaagaagccgttccgaagattcttgccaagttttcagcaaacatcagcactcatttttcattgaagcagcagcggaaaatcgaagaggcctgtaaagatagcggccgaatgcagaagctcagcgttagtgaatttatggacttatttctcatataaaataggagggtgacaaacatgacgtggatcgtcagcaagcagtcgtctcaagaggagcttgcagagcggttccgtgcgctgatggcagcgccggatctattgcagattcccggcgctcacgatgcgatggccgctcttattgccaagaaaacgggtttttcggctctttatttatcaggcgcggcttacacggcgagcagagggctgcccgatttaggcatcatcacgtcggcggaaatggctgaacgggttaaagatctggtccgctcgtctgatctgcccgtccttgtcgatattgacacgggtttcggaggcgtgctgaatgccgcccggacggcgaaagaaatgtatgaagcgcgcgcggccgccgtccaaatggaggatcagcgcctgccgaaaaaatgcggacatctgaatgggaagcagctcgtgccgattgaagaaatggcgcaaaaaatccaagcggtcaagcgcgccgcgccgactcttcttgttattgcgagaacagacgccagacagcaggaagggctggagggggcattaaaaagggcttctgcttatataaaagcgggtgctgacgctgtttttccggaagcgctccaatccgaaagtgaattcagagcgttttccaaacaaatcagtgtgccgattctcgcaaatatgactgaattcggacaaacgccgtattacagtgctgatgaattttccgatatgggctgtcagatggtcatttacccggtcacgtcactcagaacggctgccaaggcttttgagcgtattttccgccttctgaaagaagaaggctctcaaaaagaggggctttcggatatgcagacgagaaaagaattatatgaaacgatcgcttacgatgactatgaagaactggatcaatccattgccaaaacgatactgccggacgactgaaaaagcccttttttgcaagggctttttttacagcttttttttcctgaaccgcgggctgacttgattgcgtttccgatctctgtacaaaataaacccggccagaacataaaggccgaacaaaaaaaacgccaatccggccgccccctgaagaaaaagggacggaaacggggaaaacgcatgcccgaataatgcatctctcatcagtttaatgccgagcgccgcgacagcgccggggaggaccagaatcaaaagcgcaacaagccggctcatattcagaaaacccctttacgatatgatttcctttattgtccaatcgaaaaaatattttgtcaagagatcaaaacgtggtaacataggggttgtgcaaattattgcaacggaaaatacaggtgtgcaaattttttcatataaaggggtatcgggatgcagaaggtgctgattataggtgctggtaaaggaggcacggcgctcctacagattttgatgaaaacaaaactgatccggattattgcggtggttgatcaagatccggaggcgcaagggctgcaagaagcccggagatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggatttttaattcaacgcacgacggtatgatttttatagacgtcaacgaaacgatcattttatttaatcagatggcagaaaaaatggtcggccgaaaacgggaggaagtcatcggccgccaaattaaagatgtagtgccgaacacaaagctgccgcggattctggaaacgagagagccggaatataaccagaagcagcttctcggcaagcacctgcagattgtcacgacaagactgccgatcattgatgaaggcggaaaacttctcggcgcgttatgcgtgtttaaagacatcaccgacgcagttgaactggcggaagaggtcacgaacttaaaacaaatccgcaccatgcttgaagcgattattcaatcgtcagacgaggccatttccgtcgttgatgaaaacggcatcggaatgttaatcaacaaagcgtatacaaaaatgaccgggctgtcagaaagcgaagtcatcggaaaacccgcttccaccgatatctcggaaggggaaagcatgcacctgaaagtattggggacaaggcggcccgtgcgtggtgtgaggatgaaggtcggccccaataaaaaggatgtcatcgtaaatgttgcccccgttattgtggacggtattttaaaaggcagcgtcggcgtcatccacgacgtgtcagaaattaaaacgctgactgctgagctgaatcgggcgcgccagatcatccgcacgcttgaagcgaaatacacgtttgacgacattatcggcacgagtgaacaaatgctggtcgcccttgaacaggcgaagctcggggcgaaaacgccggcgacgattctgctgcggggagaatccggcacagggaaagaacttttcgcccacgccatccataatgaaagcgaccgaaaatacaataaattcattcgggtcaattgtgcggccctgtctgaatccctgcttgaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgcaaaagcgatttctgtcaatgtcagaattatcgcagcgacaaacgtcaacatcgaaaaggccatggcggaaggcgcgttccgcgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtacgggagcttgaaaatgttctcggacgggcaatgatatttttagagccgcatatggaacggatcgaacagcagcatctgcctgttttcgaatcagagctgaatgacaaaaacggcacccaaagtgattttccggatgtagaaggggaaaagctgtctcaggctgttgaaaaatttgaagcgcacatcattcaaaaaacgcttgaaaagcataaattcaaccgaaccaaaacggcgaaagcgcttggtgtcagcattcggaatctgtactacaaaatggacaagtacggccttgcaaatgacggcatgcaataaattgcagagaaagcgcaaacagctgcatgttttcttgaaaaaagccggaataaaccctttcgcatatttggcacagaacttgcattgttaaaagcggattcgcacaagaaaggtggtacaaaatgaagctgagagacctagttgaaaaagccgcggcaaaaaacgcaaaaaccattgcagtggcccacgcagcagataaagaagtgatccacgccgtcaaaatggcggcagaacacttgtcggcacgatttttactgacgggtgacagcggaaagctgaaagagcttctggcaaatgagccgaagttcaatgctgacatcatccacgccgattcaccagaagaatctgcggcaaaagcagtgcgcgcagtgcgtgaacaagaggcggacgttttaatgaaagggaatctcccgagctcaactcttctgaaatcggttttaaaccgccaggaagggcttcgttcaaaaagggtgttatcacatgtagccgtttttgaagtgccggactatgaccggctgatgtatgtgactgattcagcgctgaacattgccccgtctcttgaagaactcgggcatattctgcaaaatgcggttcatgtcgcacattcagtagggaaccctatgccgaaagccgcagtccttgcggctattgaaacggttaatccgaaaatggaggcgacgctgaacgcggctgcgatcgtccagatgtgcaatagaggacagattaccggctgcattgcggacggaccgcttgctttggataatgccgtatcccaagcggctgcgctgcaaaaagggatttccggaagcgtagcgggccaggcggatattctcttggttccttcaatcgaggccggaaatatgctttataagtcaatgatttattttgcgaaagcaaatgttgctgccgtcatcgccggtgcaaaagcgccgattgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccctgcactcggcggaacaagaatgtggacatatgacagtgaagaagcggcgattgaagatgcactgagactcgcaaaaggcatgacttataaaaatgcggctgccggtttaaacttaggcggcgggaaaaccgttattatcggagacccgcgcaaagataaaaatgaagaaatgttccgcgcgttcggccgctacatccaaggcttaaacggaaggtatattacggcggaagacgtcggcaccaccgttgaagatatggacatcattcatgatgaaacagactatgtaaccggaatttctccggcattcggttcatcaggaaatccgtctccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaaccgatatcaataaagaatctgttaaacgtgccgttgaggacttcggcgcccgcgcagttgatcccggcgacatttactcacaggcgtgcgatatttatgccccgtgtgctctcggcgccgtcattaacgatgacacgattaaacagctgaaggcgaaagtcattgcgggggcggccaataaccagctgaaagaaacacgtcacggcgataccattcatgaaatgggaatcgtgtacgctccggattatgtcatcaatgcaggcggcgtcatcaatgtggccgatgagctttacggctacaacgctgagcgtgctttgaaaaaggttgagggcatctatgcaaacattgagcgggtgctcgatatttccgcgcgtgacggcattccgacatacttagcggccgaccgtctggctgaggaacgaattgagcgcatgcgccgttcaagaagccagttcctgcaaaacggccaaagtatattaagcagacgataggaatttgatctggaggtatgaaaatgttcgaacaggaaaaacgcattctcattctgaatccaggctcaacatcaacgaaaatcggtgtctttcacaatgaacgctgtatctttgaaaagacgctgcggcatcccgaagaagagctgaaagcatttaacggcattatcgaccaatacgaatttcgaaaaataagcattcttgagtctttgcacgaacagggcatcaacatttcaaagtttgatgccgtttgtgccaggggcggcctgctcagaccgattgagggcggcacatatgaagtgaatgacgccatgatcactgatttgaaaaacggctacaacggccagcatgcttctaatctgggcggaattattgccagggaaatagcagacggattaaatatccccgcgtatatcgtcgatccggtcgtggtggatgagatgactccgctcgctaaagtatcaggaatgcctgaaatcaagcggaaaagcatttttcatgctttgaaccaaaaagctgttgcccgtcatgcggcggcgtccctcggcaaacggtatgaacagatgaagatgatcgtcactcatatgggcggcggcatcacagtcggggtccatgattgcggacgggtgacggatgtcaacaacgggcttcacggagaagggcccttcagcccggagcgtgcgggaaccgttcctgcgggtgatttggtggagatgtgtttttccggcaagtattcaaaagccgatatgatgaaaaaacttgtcggcacgggcggactctccggctacctggggacaactgacgcggtgaaggtggaaaaacgcattcaggccggagatgagcatgcgaggctcatttatgacgccatggcttatcaagtagcaaaagaaatcggggcggcaagcgccgtattaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggcgaggagcagtcaaagcaatatcagatcggcgaaggagtgaaaacaaatggcgactgaatatgatgtggtcattctgggcggcggcacgggcggttatgtagccgccatcagagcggcccagctcggcttaaaaacggccgttgtagaaaaagaaaagctcggcggaacatgcctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctcttcccggtacggtttccgtcgaatacgcaaatggtgaagaaaacgacatgctgataccgaaacaattgattatcgcaaccggttcaaggccgaaaatgctgccgggtttagaagcggacggtacatatattctgacatcagatgaagcgcttgagcttgagcgtctgccccaatccatgttgatcgtcggcggcggtgtcatcggaattgaatgggcatccatgctgaacgatttcggcgtcaatatcactgtgattgaatatgcggaccgcattttgccgactgaagaccatgatatttcaagcgagatggaaaaactgttaacgaaaaaaggaattaagattgtaacgggtgcgaaagtgcttccggatacattggaaaaagcggatggcgtttcaattgccgctgaaaagaatggaaaaaaagaaacgtatcacgccgaacaaatgcttgtttccatcggccgccagccgaacattgaagggatcggccttgaaaatacggatattgcagcggaaaacggttctatcatagtaaatgaagccggacagacgaaggaatcgcatatttatgcgatcggtgatgtcgtcggcggtctgcagcttgcgcatgtggcctcccgtgaaggcatcattgccgttgagcatatggcgggtcttaatccggctccgcttgatgccgctcttgtgccgaaatgcatttattcaaatccggaagcggcgagtgtcggtctgacagaagaagaagctgcccgaaaaggacatgaacttaagatcggaaagtttccgttcatggcaatcggaaaggctcttgtatacggagaaagcgatggctttgtcaaaatcgtcgccgaccggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaagcgattggagaagctgcgttagccgcagacggaaacgcgattcatttttaaaaggaaagaaggaggggtttgaatgactacaaaccgccatcaagcattagggctttctgacgaagaagccgttgaaatgtatagaaccatgctgttagccagaaaaatcgacgaaagaatgtggctcttaaaccgctcgggcaaaattccgttcgttatttcatgtcaagggcaggaagcggctcaagtaggcgcggcctatgccctaaaccgcgataccgactatgtgcttccgtactacagagatatgggggttgtgcttgcattcggtatgactgctaaggatttgatgatgtcgggttttgcgaaagcggctgatccgaactcaggcggaaggcagatgccgggccacttcgggcaaaaggaaaacagaatcgtaacgggctcatcccctgttacgacgcaggttccccacgcggtcggaatcgcgcttgcgggacgcatggataaaaaggatatcgtctctttcgttacctttggagaaggatcttccaaccagggggattttcacgaaggggcaaactttgccgccgtgtataaattgccggtcattttcatgtgtgaaaataataagtatgccatttccgttccgtatgacaaacaggtggcgtgcgaaaatatttccgaccgggcggcaggctacggcatgccgggagtcacagttgacggaaacgacctgctggaagtttaccgggccgtgaaagaagcgcgcgaacgggcgtctaaaggcgaaggtcctacattaatagaaacggtttcctaccggttgacgccgcattccagtgatgacgacgacagcagctacagagaacgcgaagaagtagaagaagcaaagaaacaggatccgcttcttttatacaaagcatacttgcaagaagccgggcttctaggtgaagaagaagaaaagaccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagctatgaaagaagaaatggaaagagatccgcgcgtttttgtcctcggggaagacgtcgggagaaaaggcggcgtatttaaagccacggcgggtctctatgaacagttcggagaagagcgggtgatggatacgccgcttgcggaatcagcgattgcgggtgtcggaatcggcgccgcgatgtacggcatgcgcccgattgccgagatgcagtttgccgatttcattctgcctgcggtcaaccaaatcatttcagaagcggccaaaatacgctaccgttcaaacaatgattggagctgtccgatggtcatcagagcgccttacgggggcggcgtgcacggcgcgttgtatcattcccaatctgtggaggccatttttgccaaccagccgggtcttaaaattgtcatgccttcaactccttatgacgcaaaagggctgttgaaagccgcagtccgtgacgaagatcccgtgctgtttttcgaacataagagggcgtaccgcctgattaaaggagaagtccctgctgatgattacgtccttccgatcggaaaggcggatgtaaaacgcgaaggcagcgacattactgtcattacgtacggattatgcgtccatttcgctctgcaggctgccgagcgtcttgaaaaagacggaatttccgcgcacgtattagacttgcgtacggtttatccgttagataaagaggctatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggccctgatgttccggcaatgccttatgcgccgacaatggaaaaatacttcatgatgaatcctgacaaagcggaagccgcgatgagagaattagcggagttttaaagacgtaaggaggtttttgacatggcgattgaacaaatggctatgcctcagctcggagagagcgtgacggaagggacgatcagcaagtggctggtatcccccggtgatcaagtgaataaatatgaccccattgcggaggtcatgacggataaagtgaatgcggaggtgccgtcttcttttaccggtacgattacagaacttgtaggagaagaaggccagactcttacagtcggcgagatcatctgcaaaattgaaacggaagaaacggaaaccgaagaggcgccgaagcgggaagaagagcagaataccccttcagacaccgatgcaaaccgtaaaggtaaagaccagtcaaataaagcgcgttattcgccggccgtgctcagattagcgggagaacacggcattcagcttgaagaagttgaaggaacgggcgcaggcggaagaattacgcgaaaagacattcaaaagatcattgattcgggaatgcagcagaagtcggaagcaccggcgccggctgccgttcaaacaacgcaacaagcgccgaaacaacagcaaaaacaagcgccggcaccagctctgtcagccggtgatattgaaattccggttacaggcgtcagaaaagccatcgccgccaatatgcataaaagcaaaacagaaattccgcacgcctggacgatgatggaagtcgacgtcacgaacatgacggcgtacagaaacaggataaaagactcatttaaacagaaagaaggcttcaatttaacatttttcgctttctttgtaaaagcggcggcgcaggctctcaaagagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttaccgcggaagatatgcagggcggcacatttaccgtcaataacacgggatctttcggctcagttcaatctatgggcattatcaaccatccgcaggcggccattcttcaggtagaatcaatcgtcaaacgtccggttgtcatgaataacgggatgatcgcagtgcgtgatatggttaatctttgcctgtctttagatcacagagtgcttgacgggctcgtatgcggccgattcctcggacgcgtcaaagaaatcttagaaaacattgacgaacatacttccgtctattaaaaaaactccttttgcccgggcggcaaaaggagcttttttattttcgttgtgaatcctcgggaacaagcatagtgagatgatgttttttcacttcgatcgtacaaggcgttgttccgtatacctcgccatctgtatccgcgtccatttcacgtccggtttcgatttcaatcctggaggcctgaatataggacagctcccctttgaaatcatcaaatgaaccctgctccatcgtcatcagctcccgcaacgcggcaaggcttgtgttgcggcagattaacacatcggctaagccgtcccggaggctggcatcaggcaggggaactctgtttgtcccgatataatgcccgttcatgacaagcaccattacggcttcgtcttctttcacctcgccgtcaatcgtcaatttgacaggaaacgggttcgcgcttgtcatcgttcgcaaggcgctcgtgaagtagctgattttaccgagccatgctttttcagtttcattgatatggcttgatacttcggtgatcaatccgatgccccaaaagttcagaaaatagccgtcatccgttttacagacgtcaatcattcgtttatgtccggacgcgagcgcatcagcggccttttgaaggttttgcgggatgccgagcgcccgtgagaaatcgttgcacgttcctcccggcaaaatgccgacagcgggcctgtgatcaagcttgctgatgctgttgatgcattgatgcacagtgccgtctccgcctaaaatatataaatggtcaactgaactgtcgaggttttcacaatactgacgggcatcatcctgatgtttggtcggtttaatcaaaagttcgtcagctgactgggccaaaatggggacgaccgtgccgagcgttttatcaatctgtttttgaccggcgtttccgttataaattaatactgctttccgttggctcatacgactgctcctttatttcagacaatctctttaacaagtttcccgtttttaaaaggtcataaacttacatcgggtacataaaagggacaaaacaattggatatgagcggtgtcatttgccgatagggaggttccttgctatcataagaagagatgatcaaaaaggagaggtcccagttgaatatggattttaatttatttatgaatgatgttgtgcgtcaagcccgccaggaaatcacggccgccgggtatacagagctgaaaaccgctgaggaagtggacgaagcgctttcgaaaaaaggaacgacactcgttatggtcaactctgtgtgcggatgcgcaggcggtattgcacggcctgccgcgtaccattccgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccgagcgcttccggggtttttatatggaatctgtataaatataaatatttatacactggcgttctgctgtcactaatcgaaaaaacaatgactataataaacagagaaaggaaaatatatttttcaaaaatagtattgcatcacaattaaaaagtgtttaaaatacaagttaacgaataaatattcaattttaagagatcagtagatatgggggaaatgaatcatgaagaaatggctgttggtattagctgccgcatgtatcacctttgcgctgtccgcctgcggatcaggcaattcaggctcagagggcggaaagaacaagctgattatgggtacatcggctgactataaaccatttgaatataaggacggcgatcagatcaccgggtttgacgttgatctggcaaaagctctgggcaaaaagaccggctatgacgttgaggtgcaggacatggacttcaacagcctgattacagccttgaagtccaagcaggtagatatgattttatctggaatgacacctacgccggaacggaaaaagcaagttgatttttctgatatttattatactgctaacaatatgattgttacgaaaaagggaagcagcattaaatccctgaatgatctgaaaggcaaaaccgtcggtgttcagctcggctccattcaagaggaaaaaggcaagaagctcgcttcgaaatacggttttcagcttgaagaccgcaaccggatctcagacttaacggaagagattaaatccgggcgttttgatgccgcgattatcgaagacatcgtagcacaaggctatttcagttcaaataacgatctgcagggctttgcgtcagcagatgcgaaatcagacgaatcgggctccgcgattgcgttccgcaaagacagtgatctgacagcgaagtttaacaaagcgctgaaagaaatggagaaaaacggagaaatcgaaaaactgaagaaaaaatggttcaccaacgagaaataaaaggaagctcaacttttcgttgagctttttatcttgaataaagacaaaggagatcacacgtatgaatttggatttctcagcgacaattccccaaattccttttatattggaaggccttgcggtcacattaaaaattgtgctcgtttcagcggtcatcggtcttgtattaggaatcgtgctcagcttatttaaaatcagcacgatcagtccgctgaaatggattgcggatttttatacctcgatattccgcggcacgccgctcgtgctgcagctgatgatcatctatttcggtatgccgcagcttctcggctttcagattgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttgacgaaagaatcggcaatcgtcacggtaatcggtctcggcgatattatgagacgggcctaccagtccggcgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgccgtcatcggcccttccggttccggcaaatcaacgtttctgcgctgcttaaatctgctggaaaccccgagcggcggaacgattgccattaaagaaaacgaaatcaccgcagctaaaacgaataaactgaaagtgcgggaaaatatcggcatggtatttcagcattttcatctgtttcctcataaaacggtgcttgaaaatatcacatacgcgccggtcagcgtgaagaaagagtctaaaaaggaggcggaggaaaaggcgtgcgctctccttgaaaaagtcgggctgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacaatggtgatcgtaacgcacgaaatgggatttgccaaagaagtcgcagaccgcgtattatttatggatgaagggacgatcgtggaagacggtcagccggaagaattttttctttctccgaagtcaaaaagagcacaggactttttagaaaaaatattataaaatataactgtgagaaaagaagaagaatgctcttcttcttttttttgagaaagaaacaaacagaatggagcaagcaatgtttaaaatcggttaccggacactaaagaccgcacttggaacggcgctggccatttatttagcccagctgttgcatctgcaaaacttcgcatccgcaggaatcatcaccatattgtgcatccagattacacaaaagcggtcgcttcaggcctcgtgggcccgatttgccgcatgtttattggcgatcgtcttttcatatgtctttttcggactgatcggctattatccgtttgcgatcggaatattgctggtgctgttcattccgactacagtcgttttaaaaataaatgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcagcgtacaggaaaaaaatcgaggacaacttttccgtcatcttcgccgaaatcgaacggtatttgttaactggtgagcaagattggacggggaaggaaataccggagacgcatcagatgattcaagaggcgaaaaacctcgcctatcgggacgtgcagaatcatattttgcgccatgaaaatctctactatcattattttaagatgaggcagaaacaatttgaaatcattgaacggctgctgccgaagattacctctatttcaataacggtggagcagggaaaaataatcgcccatttcatccatgaattaagggaagccattcatcccggcaataccgctcataaatttttaaaaagacttgcagaaatgagaacggaatttgaagaaatgccgctcccggcaacgcgtgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgtcctgctgctgtctccgctttggccgcttggcgcgaaccctttgccgggtgacccttatattatcgtcaataaagccacaaatgcgcttgctgttgtaaaggataaccgaatagaaggcatttatcaggtggcgacgggaaaaacggatgatttgacgcctgaaggagaatttacggtaacggtcaaagccgtcaatccgtattaccggaagaaaaatgtagagggaggcgcgccggaaaacccgctcggcgtccgctggatcggttttgatgcgaaaggcaccgacggcagaatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggacattgcaatagagcggaaagccctcataaaaaagcaggaaacccccttgcaatgaggcgcctgcttttttactgcaaatacatcataatgcctgagaggagggttgaaagtataaatacgcccaaaatgacgatgacggcgcttttcataaatttttgagacattgtttcactccttaagattactgtctaccattttaacgtgttttgcttatatgaacaagccatatcctatgggggaaagcaggtggccgcgctatgaaaaaacttgatcatgtcggcattgccgtcagctctattgaagccgcgagaggattttacgaacggatgctcgggcttacgtatatgggagacgagctggtaaacggccaaaatgtgagagttgcttttttagaagcgggaggcacaaagcttgagctgattgagccgctgtcggacgcgtctcccgtcagctcttttttacagaaaagaggcgaagggctgcatcatttggcattccgctgcgccgatatgaaggaaacgatcaaggagcttgaatcatgccgcatgaccttgcttcatcatgaaccgcaaaacggagcgggcgggaagaagatcgcatttctctctccaaaagaggcgaacggcgtcctgattgagctttgtgaaacaattgaaaaaggagaaactcaagatgaacatgagtgatcatatcagacacttaaacgaaagacgttcctttttaacaaacggcggcggagcggaaaaaaataaaaaacagcacaaaaaaggcaagctgacggcaagagaaagaattgactatctattggacgaagacagtttttcagagctgcagccgtttgccaaaagccgcacgcccgggtgccagaatgctccgggagacggcgttgttaccggatacggcacaattgacggacggcccgtgtatttgtttgcccatgactttaccgtactcggcgggacgctcggcgagacgcatgcggaaaaaatcgcggcggtaatggatctggcggcgaaaaacaaaaacccgatcatcgggctgaacgactcaggtggtgcgagaattcaagagggtgtggtatcattaaatggatacggtcatatctttaggcgcaacgtcctttactcgggagtgattccgcaaatttctgtcattcttgggccgtgtgccggcggtgcggtttattcacccgctttgacggattttgtgattatggcggaacatacgtcgcacatgtttattacaggcccgaaagtcattgaacaggtgacgggtgaacagattgacgcggaaagtttaggcggtgcgggaatacataatgtgataagcggaaatgcccactattccgcacgaacggaaaaagaggcactttcggctgtgaaaaccctgctttcttatctcccgcacggcggacagacggcgctacccgttaaaaaggaagacgccagaccgttattaaacaccctcgttcccgcggacagttcgaaaccttacgatgtgttacaggtaataaaagagctggcggatgacggaacgttttttgacattcagccgtattttgccaaaaacattgctgtcggttttctgaaactcggacggcgtacagtcggtgttgtcgcaaaccagccgaaacacttggcggggagcctcacgattgatgccgctgacaaagcgtcgagattcatccgtttttgcgacgcgtttcatattccgctattgacgatcgctgatgttccgggatttcttccgggccttcagcaggaacatgcgggaatcatccgtcacggagcaaaattgctgtatgcttttgccgaagcggcggtgccgaaagtgacgctcatcatcagaaaagcttacggaggcgcttatgtcgccatgaattcgaaagggctcggagcagatcttgtattcgcctggcccaatgcggaaatcgccgtgatgggagcggaaggcgcggcgtcgattttatacagcagagacatacaggcttctggggacccggagaaaacgaagcgcgaaaaaaaagccatatacgaaaaggaaaacgccggtccgtataaagcggctgcctgcggtatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttattttacatcccacatggacacggttgttccgggcaaaggcgttaagccgattgtggaagacggctatgtaaaatccgacggcacgacgattctcggcgctgatgataagacgggtcttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcgccgacacaagcgaaagtgagagcaaccattttcgggaaaacggctcatgcgggagtagaaccggaaaaaggcatctccgcgattacaatcgcatcaaaagcaatctctaaaatgccgctcggccgtattgataaagaaacaacggctaatatcggccgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagatgggaggccgcgcggaagtggacatcgcggtcatgtatccgggtttcaaatatcaggacggcgatcaggttgtggaagtcgcgaaaaaagcggcggcaaaaatcggccgtccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcagaaatggtcgttgccattatcgaaacagcggccaactaaaaacgaagcacccagttgattgggtgcttttttcattcttcatgatattaggcttaaagctttgcagatacaagaaaaaaccctgccggataggttccggcagggtttcagtgttatgatttggcgggctccgcctgagccgcagcctgtttctttttatgatgcgtctgctgtaaaagtacgttctgcactgtcaaaaacagtccgcttgtaaaccagtaaagcggcagcgcagccggtacgttaagcgaaaaaacggtcatcatgacagggaaaataaagaccatgatttttgctgactgcatcgcggccggattttgagcagccggtgaatatttctcgtttaatttttgggaaatataagcctgtaagaaatacatggcccccgcgcacagtgatacaagaatatcagaatgccctaagctgaaccacagaaatgagtgtgaagcaatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttttccgcatctttcgtttgtttcattttagcctgaatgctgtcgacctgcggtttgatcacagccattttttcctggaacacccgctgtttcttaaattggttcacaaacaaaggcaatacaacgatccgaacgataatcgtcaccagaataatcgacagtccgtactcaccgtggaacaggcccgccaccccttttaaaagtgccgaaaacggctcgatcaggtaatcgtggaaaaaaccgatattcccgaggcctcccgtctgagtctgagatgtcgccgcaaaagccgatcggcctgtgcacagtacgataaaaaataatcccaatgcgatccatttttgatatgttttagacaattatgtttcctcctttatatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagcgggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctacgaagcgagagcgcggggcgtaaagaccaccatgccggtgtggcgggcaaaacgcctctgtccggaactcatcgtcgtgcctccgaattttgaccgctaccggagttcgtcaaaagaaatgttcagcattctgagggagtatacggatttagtcgagcctgtttctattgatgaaggatacatggatattacggacacaccgcacagacacagggcgtatgagacagctgcagacattcaggcgagactgcaaaaagagcttttgctcccgtcaagcatcggcatcgccccgaataaatttctcgctaaaatggcgtctgacatgaaaaaaccgctcggcatcaccattttaagaaaaagagagctgccggacgtcttatggcctcttccgatagaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatttatgaatttaaaagcgtcggcaactcatccaccctgtcgcatgattcggctgactgggatgaattaacgggcgtgtttgaccggcttgcgctgtctgtgagcgaacggctccagcgtaaggaggtcatggcctgccggctgttcatcatgattcggtatgcggattggaaaacggtcacaagaagcatgaccctcagcaatccggctgatcagaaaaaagacatcatggaagcggcgatggaactgtttgacaagcactggaaccaaaacccggtaaggcttctcggcatcaccgggacggaactggttgaaaaacagcaggcgtataaacagcttgatctgttttcattcaaggaggacgcaaaggatgagccgatttttcagatgatgaacgagctgaatgaaaagtacggccaaaatctgatcagaaaaggcgccgttataaaaaaagaagaaagcaaaacaagggggacgagctttaacagagacttttttcaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagttcttagaagaggcaaaaggtaaaaatgttgtcggtacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgtcggaacaaagagcttgccgaaagcggcattcactttatcggaacgggtgtatcaggcggtgaagagggagcgctgaaagggccttctattatgccgggcggccaaaaggaagcgcacgaactcgtaaaaccgattttagaagccatttctgctaaagtggacggagaagcttgtacgacatacatcggcccggacggagcgggacactatgtgaaaatggtgcacaacggtatcgaatacggtgatatgcagctgatctctgagtcatatttcattttgaaacaggtgctcggattgtctgccgaagagcttcacgaagtattcgctgagtggaacaaaggagagcttgacagctatctgatcgaaatcacggctgatattttcactaaaaaagatgaagaaacgggcaaaccgctagttgacgtcatccttgataaagcaggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcggccttctgtccggaccagacgttaagccggtcactgaaaataaagaagagctgattgaagcggtcagaaaagcgctcttcatgagtaaaatctgttcttacgcacaaggcttcgctcaaatgaaagccgcgtctgaagaatataactgggatctgaaatacggtgaaatcgcgatgatcttccgcggcggctgtatcattcgcgcggcgttcctgcaaaagatcaaagacgcatatgaccgtgaaccggagcttgacaacctgctgttagacagctacttcaaaaacattgcagaaagctaccaaggcgctcttcgccaagtgatttcacttgccgtagcccaaggcgtgccggtaccttcgttctcaagcgcacttgcgtattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcattgattgcgggggcttttctgatattaaaaaccgcgggccgtcatgaacggcgccgcggttttttaaattttttcttatatattccaccagtggagaccgtctttttcaagaagatcgtccgaagctttcggtcccattgaccctgcttcataattcggagaaagggttttgtcggctgcccacgtttcggaaatcgcatcgacgaaattccaggaaagcgccacttcgtcccaatgggcaaagtttgtcgcatcaccgagcagacagtcatggattaatttttcataggcttccggtgtgttcatttcatcactgcagttgctgcagtagtccagcttaatcggctgagcatgagcggctccgcctaattttttagcgttcagatatagtgtgatgccttcatccggctgaatatggatgacaagcaggttcggatttacattcgtttcattgccgtaataaaggttcatcggaatgtctttaaattgaacgacgattttcgttgatttttctttcatccgtttccctgtgcggatataaaacggaacgccggcccagcggaagttatcgattaacagctttccggacacgaatgtttccgtattggaatccggtgctacattatgctcatctgtatagcttggtacagagtttccgtcaatcgttcccgcttggtattgtccgcggacgaagtagtcactcacttcgtttggagcgacagggcggagagctctcagcaccttcactttttcgctgcggatttcttccgtgttcagtttaatcggcggttccatcgccaagagagcgaccatttgcaaaatatggttttggaccatatcacggagtgcgcctgatttttcataatatctcgcgcggtcttcaacgccgagatcctcacttgacgtaatctggatgtttgagatgtagcggttattccacagcggctcaaacagcgcattcgcaaaccggatgacttcgatattttgaaccatttgtttgcctaagtaatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaaccgtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcattgaaagcaaacatttcagcctgttttttgcggtttgcggaaaaaaattaatcaggccggagaaggcccgggtgaattcacattttcagtctgatcctgtatccttagtagtacaaagatctaggaggaagcattgtggaattattatttttagggacgggggccggcatgccggcaaagacgagaaacgtaacgtccgtcgcgctgaagcttcttgaagaaaggcgttccgtatggctgtttgattgcggagaagccactcagcatcagatattacatacaacaatcaaaccgaggaaaatagaaaagattttcatcacccaccttcatggcgaccatgtttacggtcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcacttcattgttaccgcagcatccgtcattcacggtgtggaagcgttcggctaccgggttcaggaaaaggatattcccggcgcattgcaggccggcagattgaaagaaatgaatatcccgcccggacccgtctatcagaaactcaaaaaaggcgaaacggtcacacttgacgatggcagaatcattaacgggcgggattttctggaatccccgaaaaaagggagaatcgtcgctttttccggggatacgagggcatcagagcgggtaacggagcttgcgcgcaatgcggatgtgcttgttcatgaagcgacgtttgccaaggaagatgcaaagctcgcacataattattatcacgcgacgacagaacaggctgcgcaaacggcaaaaaaagcaggcgccaaacagctgatcttaactcatatcagcgcaaggtatcagggtgaatcgccgatagagcgtctcgaacatgaggcgaaagcggtatttgaaaacagtaagatcgcatttgacttcatggaggtcactgtggagcgatcttaaaaaatagacgcttgacatttttttctgatgagatataataaaacgtaataattacgatttgtataaggggtgaaaatgatgcgtgtgaatgttacattggcctgtacagagacaggggacagaaattatatcacgacgaagaacaaacggacgaatccggaccggttagaaatgaaaaagtattcaccccggttgaaaaagtatactttgcatcgtgagaccaaatagatcacgataacaaaagccattgtgccgttgcacaatggcttttgttttatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaagtgaatctgctgatgcttgatctgcctaaggctcgtcaaaaattccgcgtgtgatccttccaatttgaactgtttcaaataggcggccttcatttcttcgggaagaagcggaagcactttcgtctcctgctcctcagaaaccggatcaagcagcaccatcccgagaatatcccggcggttccggctcgcccaaagtctgctgataatcgtgccgtatgaatgcgagacgacaaggtaaggaggcttgacaccggccttcagaagaagagcgtttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatctcctctaattggttctatagggaagacggagaagcttcggcaatcgtttctcgaaaaataaaaaaagagacagccggatcgaaaaaccccggctgtcacttcatcaccatgctctgtcgtattggaccggtgacggtatttcagtattcagctgcttcgctgcactccttgcaaagtgcggatcgcggagaagttctcgcgcgacaaaaataaggtcagcgcggttgttttgcagaatttcttcggccattgttcccgtcgttatcaaaccgacggcgcctgttgcgatttcggcctgttcacggattttctccgcgaagctcacttggtagccggggaagacgttaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacggcttcaatggtctcgcctaagaagcggtagcgattttcatgtgagcctccgtattcgtctgtacggtgattggacagaggggacaaaaattcgtgcattaagtagccgtgtgcggcatgaagttcaatgatgtcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccagatgcccaaatcctgatcggaaatgcgcccctgaggattaacggctgtcgcttccacgataatcaggccgacctgtccgattgcacgcgatatgtagtgcgccatatgaaaaggctgcagttttccgtccttctcatgtgaggaatacatacacatcggtgccataacaatacggtttttgatcgttacatctttaacggtccatggtgtgaataattttcttgccatttatttcgcctcccggaatgtttttagacattgattataacaactcatgatcattcagtcatataaactgctcacaactgaacagatcgttcttattgttctggacgggcatttttttatacacagcgtggccgtatcttcataacaggcatttacagccgatcatatagcaaatatagatgagaaacgcaccgatgactgcgtggcctcctttgatccagtttgtcaggatgaaaatactgctgatgaagatcactgcgccgaaggcaccgaatattccgtttttttgagcggctctgaaatcgtcggggctcatatttttcagctgcaagtgaatattcagtaacgacatgatcggcagcaatgtgataacgcctgataaaaataagtatttcgacttgcttaaatacgcggcggccaccataacggtgccgccgataaaaaattgaatgagaaaactcatgctgaaacgctcaccttctgtttgttatcaagtataatgatggagacattgccattttatttttgattgatgtataagtaaactaaatataactaatgcattggataataaagaatgatatctgggagatgaagccgattggatttaaagaagcatttagcctttattaaaacggtagaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttctattaaggtgcatttatttgatggaaattctactgagctggaacaatggctgaaagatgaccggattgatgcggcgattgggacatcccacagcgagaagtggcatttttacccgttggccgaggacccgattgtagcggtgatgagcccgcagcatgaattggcgcaatatgaaacggttccgttacatgtcatggagtccgtcaaatgtatcgtgccttatccggagacacattttgatgtgctgaaagtgttaaaggaagaaaagatcactccgcgggttgcttatcaaatcagaggggatgaagcgattattgcaatggtgcggaataatctggggatcagcatcttgccgcagcttttggtgaatgatggtgatgtgctcatcaaacggttcgaccggtatgtctccaggcagctcggcattttgacagctcgtgcaaaggagacgcagacaccttctgtccagaaactgattcaatgcatacaagaatgggttgcggtccatcaggcttctgcctgaagaagcctgatatgcgtttaagccggttcaggataatagaccagcaataaatatgtcatcggttccgaggaatgaaaataactgtgcggcatcgcccgaagtcagcacatgcttttcgtcatgaagctcaaccgtcaattcaccgctcttgattaaaatgattcccctaaatgtgattttgtctcataggcgcagcccggcttcaggtcaactatgccttgaaaacaaaaatttgaccgtgacggtggtgagcggggttattttgatgtcgggctttcgtctgtttatataaaaagggcatcaacggcacatgctgttgatgctttttttgaaatgctagggtttggagagcacttcaattccgacgttgaccattttgtccagccccataaaagacaggcagattttggcgcgtctttttcttttatcgatttttttaataatgccttccattcctttaagaggccctgaggcaacggttacttttgaattttcaatatagacttttgaataatctacagtgtctccttctccgatcagcctgataatagggaggatttcttcatccttaattgtcgtgaaataggttttgcgctctttggaataatatgctccgttattcacgattctgcatgaaatggggagttctttgattttatgaaatgtccgctctgtcatctttgttttaaacagaacatatcccggaaacatctttttgagtgcctcgtatttaattccggcttttcgttctgtgacttttttcttgggtatgattgagtagagagcctgctcatcaaactgcagacgcagaaatttttgaactgcttcttcttttcccgactctacaaaaagtgcgtaccatttcatgactggatcctccttagaataataagaaattattatacaaagaaagtatttaatggatagtatttaaagtgattaaaaatttttctaattcgtcttttttttacataatatatgaaaatgaaaaataagtatagacccaattgacagagaggcgatgaattttctttgacatgaaaagggttcagggaattatctgacatttatcccgaaacaattatgccgactgtccaccgaatataaaactgtggaataaatgtcagaaaataacgaaataaagccttgacattattatctataaattgatattattctctttaaatagcaactatttgttaaatttattaaattaaagtaaagcacctattaaatttcaatcgctgtttcggcacgttgaagaggaaatagggattataaaaatgttgcagtgtatatatctacatatacatgataagggagaagtgtgccgtcatggctgttttcgggcatattggcactgcagcttgtcatgcgaaacattcagtaaacaagcaagatgttttaatataaattatgttagaaaaggaaaacacaatgcgtttgcgatttttaaacctgtgctgaatcgcaaacgcgtttgtgtttttatttttatggcggtgtttacaccagtcaatatatgaaataagagacgtttttgtatggagaaccacatgtgatgtacaaaattggcgatggggaaaggatgaggataagatgcttacgtttgtgttcccggggcagggttctcaatttaaaggaatgggagccgggctgtttgatgaatttcaagatctgacacgtcaggctgatgacatattaggctactctatagaagaattgtgcctggaggatccgaatcatcagctggggaaaacgcaatttacccagccggcgttatatacggtaagtgcactcagttatttaaagaagattaaagagtccggcagagagcccgattacgccgcagggcacagtttaggagaatataatgcgttatttgcggccggctgctttgattttaagaccggtttgcagcttgtgaaaaaaagaggggagctcatgagcaaggcagctcccggaggcatggcggcggttttggggtttacggctgaacaagtaaaagaggttctatccgattatcatctgaccggcattgatatcgctaaccacaattcaccttcgcaaattgtgatcgccggaacgaaacaagacattgaaaaagcgggccccgcctttgaaaaagccggcgtgagaatgtatcttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgataggacttgaaaataatgaaattgcagaagtcgggcccggggaagtgctgacaaaactgacgcggcagattcaaaaagatgccgtcccattacctatgccgaaagaagagtctgatactgctgatgttaaagcatcggcagctcattcacaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggaaccatccggtctgcactgcggcaaggggaaacattcggaatgaatcttcttcatcatatgatgtcacctgacaaggaagtcagaatgatagatttatatttaaaaaacggcattcaccttattgaagcatcggcatttatgggcataaccccggctctcgtgatatacagggcaaagggattaagcaggaatcatgacggatcggtgtcagtccaaaacagaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggcgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagataagtatttccagcgcagttttgaggaagtgtatgagcagttgaaacgtgataaatctcctgaacagatcgccaaagccgaacagaatccgaaacacaaaatggcgatggtatttaaatggtatttttcccatacgacgaggctcgctctggaaggaaaaagcgaaagtaaaatagattaccaaattcattgcggccctgcgctcggcgcgtttaatcaatgggtgaaaggaacccctcttgaaaattggagaaacaggcatgtcgacttgatcggcaaacagctcatggaagaaacagccggccttcttgcgcaaaggctggtatcgattacaggctgagtatgaccagacattacattttttctgcggaggactaccatgctgattgaaaatcatgaattaacgatgagccatgtcggattagggaatttgaatgagtacgcgctgctgctgttattcggcaatgcacacagtcaccatttaacggacggaacgggattccggcctgatcagatggccgatcatcaagggctgattttgtatccggcttattttatgacacatctcaaagttccttcagataagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgttgacgtcacacaaacagaaggttcgacgcgcaaagtctcagcgccgaaggctgaatgtattgcggaactttctaagctagccaagccgccttacgcgctgatgcggtcaaagaaagtcagaacggacgctttcggtatgaagccgggaaacctcaaaacagcggaccccgtttcatatcgggttcctgttgatcaggatgctgcgccggggcatgccatggtgtttgcgaaattcagcaagataatggatgcggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaaggaatcatacattgctggccatttccaaggtggataagctgctggcggtgccgacctcttcacaagatcatattccggattataaacgggtcatcagaagtttataaaatgaagaatggagctgaaagcaaatggaacaaaccaaggaaatgaagcagatcatcgctcaaattattcaggatattcaagaacagcagtcatatcgggccgtcgaagcgggagatgatgtgagagtcatagaggatctgggcttctcatcactggatatcgctcaattagtcgcacagatggagatggaaaccggagtggatcctttttcccaaggagaaacgatttccagcattacaaccgtcggcagcatttgtgatatttatcaaaaatacatggacagtgctcaatcatgaaaacagaaagcaggggagatatcagctgggtgactgataagcttagggaaacgcaggacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgaaggttctgaaagcgcctctcaccctctgcttgatgacctgcgcgagaaaggggagtcaggcattattattttcacatcgggaacctccggcaaaagcaaagcatccgtgttaagcgccggccggctgcttgaaaaatacaaaacggcgaagagaaaaccgctgcgtacgctcatttttctgaaattggatcatataggcggcattaatacgctgtttgcgattctgtttaacgggggaacgatcgtcacatcagacagcagaacgccggagtccgtttatcaggcggtcgacaaacatgctgtccaagtgctccccgccaccccgacatttttaaacatgctgctgatgtccaaggcggatgccggctataacctgtcttcactccagctgatcacttacggcacagaaccgatgccccaatcaacgctgcgcggcattcaccggctgtttccggatgtacggctgaaacaaacatacggattaactgaactgggtatattctcaacgaaatcaaaagacagccaatccacttggatgaaagtaggcggtgccggaacagagaccaaaattaccggaggcacgctttgggtccgttctgagtcggcgatgctcggctatttaaacgcaccgtcacccttcgatgaggacggctggtacgacaccggtgaccaggtggaaacagacggcgaatatataagaattctcggaagaaagagtgaaatcattaatgtgggcggagagaaagtgtttccggcagaggtggaaagcgtctttctggagatacctaatgtccgggatgttctcataacgggccgaaaaaatccgattacaggcgagattgtcgcggcagaggccgtacttgaaaaagaggaagatatcaaatctttcagaaagcgggccgtagctcattgcagacagaagctgcagccatatcagataccgcagatcatctctgttacagatcggaaactgtctaatgaccgatttaaaaaaataagaaacgtgtaaaacaggaggcaaatatgaataacggaaaagtagcggtcgtcagcggaggtagccgggggctcggaaaagcgattgtacaggcgcttttggatgagaattacaaagtagccgctttcagccgcagtgaatctgattttattaacacattgagagagagtgaaaagtaccgtgaccgcttttattgggaagcggcggatgcggcggatgatgccgccatgaaacagtttgttcttcaagtgtaccgcaagttttccagaatagacggcttggtcaataacgccggtttgaaccttgatcagctgctgcccctgaccaatgatgaagacattgatcgcatcctcaatctgaatatcggttcagtcatcaagctgacccgaaacgtttcccgggtcatgctgaaacaaaattccggatcaatcgttaacataagctccattatcggttcaagaggatttaaaggcacttcagtctacagcgcatccaaagcggctcttgacggcttgacgcgaagcctggccagggagctcgggtccaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgttttctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcggaaaagctgggtgccgaggtgaccgaagcagaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaagtgcttcctgtacaggcggctgaaaaggtgcctgaaccgggaacggacaggagttctgatattgcggttatcggaatgagcgggatgtttccgaaagcggaaaaccagcatgatttttgggacaatttaatggaaaataaagattgtgtctccgaaatccctgaggacagatgggacagctcttattactcggaagagaaaacggcagaatacgcgtcatacagtaaatggggaggttttattgatcgtccggatcgatttgacccgctgtttttttctgtttccccgtgggaagctgatttaatggaccctcagcaaaaattgtatgttacgtgctgctgggaagcgatggaggatgccggttacgggaacccggcggcgaggccgacggatcaaatcggtgtattcgccggagtgacctggaatgaatattcattaattgcacacgaagaaggtttcctcaaagatcagtataaaggccccggctccttatattggggcattccgaaccgggtttcttattttcttgatctccatgggccgagcatcgctgttgatacggcgtgttcttcatcgcttgtcgccgtccatcaggcttgtcaggccattatgtcgggcgactgtgaaatggcgcttgccggaggcgtcaacctcagcttacacccgcaaaaatacatgtttttaagccaatcgcattttctgtcttctgaaggaaaatgccgcagcttcggtgaaggcggaaacggttacgtgcccggtgaaggcgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctataaacagagccgcggtaagtccggcggatatcagctacattgaagctcacggtaccggcacggcactcggcgatccgattgagatacgcggtctgtctatggcatttgagaaacagaccgatgagaaaaatgactgcggaatcggctcggtgaaatccaatatcggacatttggaagcggctgcagggatcgccggtttaatcaaggtgcttttaagcatgaaacatgaaacgcttcccgccagtctgcacgccgaggaactgaaccgcaagatttctttttctgattcgccattttatgtcgtccgaaacaatcggccgtggccggctgaaggagataaaccgagaatcgccgcaatcagttcattcggcgcaggaggctctaatgcccatctgatcgtaggtgcttatcagccaaaacggcaagcggacgggaatactgagcaaaaaccgcatgccgtcgtactaagcgcacattccgaacagcagctgaaagaatatgccggaaaattgagctcctttcttgcccgattggaaaactcgccttctgccggcggatacagcctggaaaatatcgctgccaccctattgtcaggcagagagcctttctccttccggcttgctgtcattgcgtcatcccttcccgagctgaaacagcgattggacggttttgtgagcggtcacagcggcggcaggcatatttacttcggaaaagcgtcacccggacggccggacgtttcaggccaatccgtttcagatcctgaaaaatttgccgcgctgtgggtcaaaggccttcaaggtttcaaaaagccggagacgccgtatcagaaagttccgcttcctacgtatccgtttttaaaggaaacgtcctggctgaccgaccaaaaaaagcggtatacgaaaaagccccaatctatcaaaaggcgtgaagcgctgcatccgctgcttgatgagaatgtttcatccgcccggaaagggacgtttcaaaagatattttccaaggatgaatatttctttaaagatcatttagtgaacgaaaaatatgtgctccccggagtctgtcatcttgaaatggcggcatacggcgcggcattgtggggagaacgcccggtcgtctctcttcaaaatgtgtggtatatggagccgattgtgacagggacagacgcaagatccgtcatgatagagtttgaagcggaaaaagagcgtataagctatgtcattaaggaaaaaggagcggacggcactctcttttcgcaaggagaagtgatttgtaaagaaaatggagcgtcgtttgaggccccggtctttcagcttccggcgccatttacgcagagaacggagccgaaagacatctatcactcgttctctgaggcgggaatcgtgcaaaaggacagttttcaggtcatccgcgaattctcttatacagaaaggaaagcactggccaaattaacgctcccgtcacacttggaagcggattttaaacagtacatcctgcatccgtccttactggatggcgctgttcaaactgcaatggcgcatgtgctgcaatttcaaaaagagcctgcgcttatcgtaccgttttccttcggagaaatacagctgcttaaaccgttagcgaaaaccgtatttgtgcatgcggaggtaaaagcggcctccgttcaccaatttgatctgcatatttgtgatgagcgcggtgtgctgctggcggcagtgaaagattttatcataaaagaggtgcgggaaagcgccgggtttaaccaaaaagccggcgtcatgccgaagaaaagccgtgaaacggaattgcttatgacaccggtttggaacaccgtcaccattccggaaaccggcatgtctttcatgcgtgaagaaaaaataatcgtcatcgggggcgggccggattttcagcaggctttgaaagagatgtattccgatgtccgttttccggacatcacttctttggacagcgcggaacaaatggctgaaacactgaaagcgcaaggctcttttcaacacatgatatgggcggcgccggatcatccgattccatccgtttatgatgcggatacggccgacggacaggagcacggggtcatgcagcttttccggctggtaaaatcgcttctgcttctgaattttgacacggaacaactatcattgacaatctgcacgtttcaagcacagccgattcatgaacatgatgaggtcaatccgagtcatgcaagcatacacggattagcgggggcgctcgcaaaagaatacagcaattggagcatccggcttcttgatttggaatctcaaaggggagaccggcatcttcccgatatcttctctttaccggcggaccccgagggaaatccgtgggtctttcgtgcaggtcagtggcaccgccagcaattggccgtctgccagcctcatgcaggtgagccttcattataccggcacggcggggtttatgtgattatcggcggagcaggcggaataggagaagtatggactgaatatatgattcagacctatcaggcgaaaattgtctggatcgggagacggaaaaaagatacacagattgaaagaaagctgaaaagacttgcggctttaggtcccgcaccgcaatatttcagcgcggatgctgcggattatgattctctcaagcgggcgtatgacaccattgtgaaggaacatggaaaggtgcgcggaatcattcattccgccatcgtgttatcagaccggagttttgccaatatggaagaggaccagttccgcgcttcactttctgcaaaaactgatgtcagcttgcagattgcccgggtagctgaaggggaaccgctggatttcttgctgtttttctcttcgatgatgtcgtttcaaaaagcgccgggacagagcaattatgccgccgggtgcacgtttaaagacgcttttgctaagcggatctcacaaaaagcgccgtatgccgtaaaggttgtcaattggggcttttggggaagtgtcggcgttgtcgcttcagaacaataccggaaacggatggagcgggacggaatcgcttctattgaggcgcccgaagcgatgaaaacgctggaaaccctgctttcgggaccttatgaccagctggcgctgatcaaaacgacagatccggtttttatgaaagatgatctgaaagaacaagtaacggtttatccggaaaagattccttccgcactcggacaattagcggttaacatcacgcagaatgacgaagctgagcgggtaaaagcatcaaatgtcatgagctgcatgagagagatggaatccctcattgaaaaaatacttgtatcaaccctttatgagatgggcgcaaggcttgatgagactttgccgttatttcaatcggctgccggcataacggaacaatacagcagatggctgaaagagagctttgtcttcctgactgaattagcgcttgctccggaaaaaacggatctaggggaggtgtgggaggaatgggagcggaaaaaagagacttggctgcgccggaaagacatgagggcgcatgtcagattggcagaagagacattgcgtgtgcttccagacattttaaccggtaagcttccggcaacggaagtgatgttccctgactcctccttccgtcttgtggaaggtatttaccgcaataatatcatttctgattttttcaatgacaagcttgctgacacattgattgcagttttgcgggagcgtctggaaaaagacccgcaggcgaaaatccgcattttagaaatcggagccggaacgggcgggacgagcgccgcggtcatgagaaaattgaaaccgtatgaagcgcatattgccgaatattgtttcacggatatttctaaagcatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctgcgctgcgccatgcgaaagcaatgctgcaaaaaaacggccagctgtttataaatgagatcaacagccgcaccgtattcaaccatgtgacgttcggccttcttgaaggctggtggctgtatgaggatcatgatttacggattccgggctgtccgggggttgagccggccggctggtcggaagcgctttcacttgaagggttcgtccatcctctgtttccggctgaagccgcacacgacttaggccagcagattatagcggctgaaagtgacggaacggtcaggcttgccctcccgcaggcgtcagaagaaaaaccggagcgccgtccgtatgacgcagatggtctttcggatgatacattgcatttcagcttgagagaaaaaagcgttgaactgatgaagaaggtaatcggtgaagcgcttaaagtgccggcgcatcgtcttttatcccatgaacctttaaccgcatacggattggattccatactcgtcgtcagactgaccaacgcgttaaaagacgtcttcggttctgtcagcagcactttgttttttgaatatcaaaccattgatgagcttgctgattactttctgtcttcccgtaaagaagcgctcgagcggcaattcgggaatggacgggctcattccgaaaacgccggacggatgcaggctcccgcagaaagcgccgcgccgattccaaacgtaagggaacggggcatcacatatctgacggaattaataggaaaaacgctgaagattccgagcaggagaatggatccgtcggtttccttaaccgcatacggtttggattctattctggtcgtcaggctcacaaatgcttttcgtaacgtgtttgaccaaatgaccagcaccctcttttttgaatatcagacgatagaagaaatcgcggattacctgcttctttctcagcggggagcatttatgaaagcgatgggtgtgcgtgaggagcagctgtctgatcacacagataacctgaatgtaattcctcaaaacgaggaagaaagcaggacaaacggagatccctatattcaggatatcgctgtcatcggtctgtcaggccggtatccgggcgccgatcacgttgatgagctgtgggaaaatgtaaaagccggcaggcattctattacagaagtgccgaaagatcgctgggactggaaaacgttttataacgaggaacgcggaaaatgggggtccatttattcaaaatggggcggtttcctcgatgacattgataaatttgatccgctgtttttccgtatatctcccgcggaagctgaaaggatggacccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaattttcaagggccgagtatggctgtggatacagcctgctcttcttctttaacagctgtccatctcgctgcagaaagcctgcggagcggaatgagtgaaacagcgattgccggcggagtcaatcttatcgttgatccggctcactatgagcggctgtccgctttttcaatgctgtctcccggtgataaatgcaaatctttcggagacagggcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccgaatccgaaagcgcagtttgatctgatcgtagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttcaattaaatcaaatatcggacatttagaaagcgctgccgggattgcgggaatcaccaaactgcttctccaattgaaacataagaggattgccccttcattgcatgcggcggaattgaatccgaatattgagtttgagcacactccgtttttcgtacagcaaaaagaaacggaatggaaacgacctgtcttgaatatcacgggtgaaatgaaggaatatccgagaattgccggtatttcctcttttggagcaggaggggcaaacgcgcatatcatcattcaggaatatgtgccgtctgacagcctgaaaccaagggaaaacgcgtctgtttctccgcaaaaaccggctgttattattttatcagcgcgaaatgagcagcaattgacagagcgcgcccgccagcttctggatgatgtcataagaaaaaaacgttctgacggggatttggccaaaatcgcttacacgcttcaggcgggaagagaaccgatggctgagcggcttgcatttacggccgagtcgatagaagaactgaaaatgaagcttatgagtttctcaaacgatcatatcgaacatgctcatatctggcggggcaggacagccaaacatcattcattggcggcttcgctcacttctgatgaagatatggcgcttaccataaatgcctggctgaaaaaagggaaatacggaaagctgcttgacctttgggttaaaggacttgacgtcgattggtcagctctttatcagcgcaacccgggccgcatcagtctcccggcttatccttttgccaaagaccgatattgggtcacaaaagctgatgtgtcacttgacaaaacaggctcagcggaaagtgagaaagcagccagacttcacccgctgctccatgcg

SEQ ID NO: 116 - DNA, 103292 bp, Bacillus velezensis FL50S
ggcgagttccgcttgcagcagcatttgatttcccaccattaccgcatccttgattcttatgatgatctgtggttcagcagttttgaaaaggcagaagctttggagcggcttgatgagctgtttttggaggcggaggaagcgaagcgctgacgcacctccggttgatgtattttctgacaagtgagaaaatatgtataaattccagccaaaggagagattcgcatgaagcctgaagatatcgtccgaagcggcccgaatcagtacatatgcaaggaaggaatcgcaaaagaacttccggggctgctggagacattcagaaaacccgttattgtgaccggaatcaaatcttatcaggcgttctccgattacggcggcggttcttcctgggatgtgattcagcacaaaggatactgttcacctgaggcggtgcgtaaggtctgcgggcaggcggaagacgcggatgtgatcatcggtatcggaggcggcacgattttggatttggcaaaagcggcggcagaccggcttgatattgaggctgtgatgcttccttccattgcggggacgtgtgcggcaagtacgccgttgagtgtcatatatgatgagagcggcaattttatcagagttgattatcacaagcgttcaagctatttgacgcttgttgatccgctgtttttgctttcctctcccattgaatatatgaaaagcgggatcggtgatacgctggcgaaatggtatgaggccgaggcggtcatcagaaatacggaggaagcgccgccgctgatggcgcaggcgggactgagacaggcggaatatatccgtaatctgttattgcgttacagtgaagccgccgtcgtaagcatggagaaaggcgagctgtccgtgccgttcatccatacggcggaaacgatcattatgcttgcgggaacggtcggcgggtatggcggccgtttgtgcaggatggcaggggcgcatgcggtccacaacggcctcagttttcttcaggagacacatcaggtgctgcacggccagaaggttgcttacggcatattggtgcagctcgcgcttgagaatcggagacatgagattgaagagctgcttccgttttaccgccggctcggtttccccgtcagtctctgtgctctcggcatccttgacaaccatgaggaagcaaagcgccgcatcgcttctcacgcctgccgggcggaagaatcgttatgcttaatggggcaatattgcgagaaggacgtgtcagcggcgattgaatcgctcgaatcagcacaaaagacaggatagagcttgtaatctgtcttgtctttattttttgaatattttcgttataatgagtggggtaaagaaagggaggggccaaaggacatgtatcaggcgaagaagatgttgttattaggatcaggcgagctggggaaagaagtcgtcattgaagcgcagcggctcggggttgtcactgtagccgttgacagctatgagcatgctcccgccatgcaggccgcacacaaaagctatgtgattgatatgcttgataaagcgcaggtcagagaagtcattgagaaagaaaaaccggacttgatcgtgccggaagtggaagccattgcgacggatgagctgctgaagcttgaggaagaagggtttcacgtcattccgaatgcgcgtgcggcaaagctgacgatggaccgtgaaggcatcagacggcttgcagcagagacgcttcatcttccgactgccggctatgaattcgcgaatacatacgaagaatttaaagaagcggcggaaacaatcggctttccgtgcgtggtaaagccgctgatgagctcttccggaaaagggcaaagcgtgtgccgctcggcttccgggctgaaaagctgctgggacatggcaatggaaggcggccgggtgaaaaacggccgggtcatcgttgaggaattcattccgtttgaatcagaaatcactcttctgacagtgcgcgcggcgaacggtacgtccttttgcgcgccgatcggacatgaacaaaaagacggtgactatattgaatcatggcagcctcatcatatgacggaacagcagattgaagaggcgaaacacattgcgaaaagcataacggacgagctcggcggatacggtttgttcggggtggagcttttccttactgaagataaagtatatttcagcgaggtgtctccccgtccgcatgatacggggctcgtaacgcttgtgacgcaaaatttgtcagagtttgcgctgcatgtccgcgcggtcttgggattcccgattccggaaatcattcagctgtcgccgggggcaagccgtccgctgaaggcgcccaaagagcttgctgattatgcggttgaaggtttggagaaagctttggcggtaaaaagcactcaggtccgcgtattcggtaaacccgtcacgaaagtcggacgccgtatggcggttgcgctttctgcagccgagaccgttgaagaggccagagaaagagcggccgaagcactcagtcatttatcaattacataaaatgatcttaaaaggcgttttgaccgtaatggtaaggcgccttttttgtttggacagactatatactggaaaacagggttgtgagataatgtatgaggccgttttgtgccggttttttaattcttgaaactttttatgtccgcaatcgttatatgtaatgttctcatttcacggagaaggaaataacaatacatcatacggcttttcattcatcaagaacggacaatccggatcgcagcatggaatatttaagcagggtaatccggaatagaggaaaccatgattgcttaccttaatatgaacggcgaaaaaacaaaaatcaccagattagattgttcaaataacaccaaatgctgtataataaaagaatttgaatgatagcattgaaaggatttcattttatgtttccgtaaaatggagtctttatgcatacgcagtccgatttgatatggttttaattggaggtttgtgtaaactgtgaattatatacctagtatgattacaattggaaattttatttgcgggctcttatcgattcattcccttttgtatcataatatacactctgcggtgatctttattttcaccgggatgtttcttgatttctttgacggtttggccgcccgtaagctgaacgcggtatcggagatgggaagggagcttgactcttttgctgatctcgtgacgttcggcgtagcgccgtccatgctcgcttacagtgtttcactatatacgcttccgttcatcggaattttaatcgcgctttcctacagcatctgcgggatgatccgtctttccagatttaatattgaacaaagcaagctgccgacgtttatcgggatgccgattccgtttgcgggtatgtgtcttgtcattttgagctttatcaataacgcttttcttctgggggcgggaacgatcgcgctcggttatttaatggtcagcaacattaaatttccgcactttaaaaaacaggcgcctgaaaacctggagagcagaagatggaattagttcagcaattaatatccgattacggatatatcgcgatttttcttatgctgacactcggtattatcggattgcctattccggatgaagtcatgatgacgcttgtgggttacttcgctcatttaaacgtgctgaattacgggctctccattctgatcagctttatcggagcgctccttgggatgattatcagctacttcatcggcagaaaagccggccggccgtttattaataagttcgggaaatgggtcggcctgaaggaaaagaggatggagaaagtagacaggtggatgaagaagtacgggccgtacaccattattttaggttatttcatccccggcatcagacacgtgacctgctacttttccggaatcggcagaatggaattcaaaacctacttatgcttcgccgccatcggagcgtttttatggtgttttatttttattactataggaaaattcataggagtaatcaatgtttaatactgccgctaaagttctttaccgttcattgattgaactgactaataatcgattgacgtcttatctcattaaaaacttctgtgaatcgaaactgagcaagccgatgattccgctgttttccaaacactatcgcattaactggaatgaaacggaacgcacggcttctgactttgattcactggcgtcatttttcattcgtgatattaatttgaatctccgccccgtggcaaaagagaagaacgccatcgtcagcccggtggacggcgtcgttcagacggtgggcatgattaatcccaatcaaactttcatggtaaaagggaaggattattcgttcgctgaactgacggggtttaaaagcgccgatcacaagtataacggcgggtgttttgccgtgctttacctgagcccgagacattaccaccgcttccattctcccgtcagctgcacgtataaaaagctggccgagctggggaaacgctcctatcccgttaatacgatggggttaaagtacgggaaagatgtgctctcaaaaaattaccgttatgtgtacgagctgacccgtgctgatcagcagatgctcatgattccggtaggtgcgatgaatattaactcgatcgttcagacaaacaccggaaaccggcttgagacgggggaagagctgggctatttttcatttggatcgaccgttattttagtattcgagaaaggtatgtttaccccttcggataacctgactgaaggccgtgaattacaggtcggtcagatcatcggttatgcggagtcacaggaggaggcgtccgctttataaaagctgctcctcttttttatatggtgtaaggaagtggactttatggaagaaaaggatttgggaaagctgatcgaacagtaccggcatacaggcgatcagcaaattcttgaagcggtgcgggatgcatgccggcctgtcgttgaggcgctcatctcagaactggctgaagacagcgccgatcttctgcgggcaaaaggccgtgaccgttttccgtttattatcggcaagtatcagaccgcggccggcctttcgcttgagacctttttgcgcaatacgtatcggttttattttcagcaggttttaaaaggcgaagcgtgactggaagaaagagtacggacggaaatgttcatctttcgcccgttttcctgtatgatatagtatagtgtgcgtgatcattaatataattgaacagggtgtataaatcatggaaaaacaatatagagttttactttattataaatatgtaaagattgatgagcctgaagagttcacggctcagcatttgaagttttgtaaggagctcggtctgttaggccgtattttgatttctgaggaaggcattaacggcacggtgtccggaacggttgaacagacggaacaatacatgaatgcgctgaaagctgatccgcgttttgccgacatgccgattaaaattgacgaggctgacggccatgcattccgcaaaatgtttgtgcgccataaaaaagagctggtgacgcttcgtctcgaagatgatgttgatccgaatgtcacgacgggcaagcatttgaaaccgaaagacttttatgagcaaatgcaggatcctgacacgatcgtgatcgacgccagaaacgactatgagtatgacctcggtcatttccgcggagcggtcagacctgatattgaggcgttccgtgagctgccggactggattgaagaacacaaagacatgcttgaaggcaaaaaaatcctcacgtactgcacaggcggcgtacgctgtgagaaattttccggctggctgctgaagcagggatttgaagacgtgtcccagcttgacggcggtatcgtcacttacggtaaagatcctgaagtgcaagggcagctgtgggacggacagtgctatgtgtttgacgaaagaatcagcgtaccggtcaaccgcgtagagcacgttatcatcggaaaagattatttcacgggcgagccgtgcgagcgttatgtgaactgcgcaaatccggcatgtaataaaaaaatgatctgcacacctgagaatgaatacaaatacatgcgaagctgcagtcacgaatgccgtacgaacgaacgaaacatgtatgtgaaagagcacgaaatgactcaggaagaaatcaatgaacgccttgctttgattgaaaaagaggatcatgcggcgattgattaatagaaaagaccaccaatgaggtggtcttttttgtgtttacatactttctgtccgggcggtctggtctgccgtgacgggtcctttatatttgaaggctttttcccatttggatacgacgatgcaggcgaccgcatggccgggcacgttgacaccggttcgcgccatgtccatgacgcggtcgacaccggcaatgatggcgacgccttccgcagggagaccgacggcattcgctgtcgccagaagcacgacgagtgagcctgacgggacggcggcaatgcctttgcttgtcatgacgagcacaagcatcatcagaagctgctgagaaagcggcatctccacatgaaacgcctgcgccaggaaaatacaggacaccgataaatagaggcttgaaccgtcacagttaagcgataaacctgacggaaccacaaaggagacgacccgcttcggacagccgtatttctccatccgatccatcagctgaggcagaatggtttctgtgcttgtcgtggagaaagcgatcaaaaacagatcccaaatcattttcagcacttcaaagtacttgattttaaagataagccccacgatcggaaacagaacgaagaggatcaggaacagcccgagaaacacagtgccgatcagcttcagcatcgggagcagaagcgcgattccgaattgcccgacggaggcggccatcagggcgagaacgccgatcggagcggtgaccatcaccatctgcgtcagcttgaacataatatttgccgtggattcaaagaaactcatgacaggtgcggaggctttgccgatgccggctgcggcaacaccgaataggattgcgaaaaaaatgacggcgagaagatcatttttcgccataacgtcaatgatgttaacggggataatatcaagaagcatttgtttcaggtcgactactttttccgtatagccggaaagctcgtgaatgtcttttttagcaagatgagagaggttaagtccgactcccggcttcagcacgtttgccaataacagaccgagcgccagaacaagcgtcgtaatcacttcaaaccaaataatcgttttgatgccgagactgcccatttttttcatactgccgctgccggcggctccgataacaatggttgaaaacacgatcggcacgacaatcattttaatcaggcggataaatccgtctccgacgggccgcagcgccatcccgaaatccgggaagaaatggccgatcaatgctccgatggctaaagcgatcaaaatctggaatgcgataaattttttcaagcgaatcccccttttacttgcgcatttcttacgtaattcgtgaagcaggcggcaaccaccttcctctccgccataaatttgtcacattattgactgtgcgaaaggaaggattgctttacattatgtaagcgcaatcattgaatatgacagaaagtccgcattggaaaaaaagaaggagcataaaaataaagaaagatttctgctgaaaatattaaaaattttgataattatcctcttataagtggtatatttgatatgatatggtcaactgcattctcatatatctgtgcatacaagattcgggacagaaaaaacatgcagcctagaaaagactgaaaatttaaacaattagaagaaaggtgtgcttttgttgaatcaactgattgaaagacgtaaggtcacagctagaaaagaaaaaccggattccgcttcattgggatttggcaaatacttcacagattacatgtttgtcatggattacgaagaggagagagggtggcatgatccgagaatcacaccttatgaaccggtccatctggatccttccgcatcggttttccattacgggcaggccgtatttgaagggctgaaggcttacaggtcagaagacggacgggtgttgatgttccgtcctgaccaaaatataaaacggctgaataaatcgttacggcggatgagcatgccgcctcttgacgagaagctggcgctggaagcattgatacaattggtggagctggagcaggaatggataccgatagaaaaaggaacctctttatatatccgtccgtttgtgattgcgactgagccttctttaggcgtccggccttcaaagcgttacaagttcatggttgttctgacgccggtcggttcgtattacggcgatcagctgaaaccgatccgcatttatgtggaggatgagtatgtgcgtgccgtcaccggcggagtgggcgacgtcaaaacgtccggaaattatgcggccagcttacaggctcagcggaaagccgaagaactggggtacgatcaggtgctttggctcgacggggtggaaaagaaatatgccgaagaggtagggagtatgaatatctttttcatcataaacggagaggccgtaacgccggcgttaaacggaagcattctcgggggcatcacacgcgcatctgtgatagagctgttaaaaagctggggcatccgtgtcagggaagaacaggtcgccattgatgacatctatgaggctgcaatgagaggcgaggtgtcagaagtattcggtacgggaaccgcggccgtcatctcgccggtcggcgcgctgcacattcacggagaaacgattgagctgaataacggtttgatcggtgaagtgtcagaaaagctctatgaaacgattgccggcatccaagtcgggaaggtgcgggattcgttcagatgggtggttgaagtataaatgaaaaaagaacccttgcgccgcagggttctttttttggttattgggattttacggcttgcacgcgggctctgcttttccggtttttcaagtaataagcggtgtagcaaacggccataaaggcaattccgcaataaagggcgatggcctggttcggatcaaaagcgatgccgatacaggaggcgaggcacaggagaaaggccgctatcggtacggccggatatcccggcgtcctgtatttcaagtctgaaagctggtgcccttctttaagaaaccgtcttctgaacaaaaattgcgaggcggcgatgctcatccacacagccactaccgcaaatcctgagacagagacgagaacaagatagactgtatccgctgcaaatacgcttgacaacaatgacagaatgccgccgatcatactgaagatcagagcgttaaaaggaatgcctttagaggtcagcctggcaaaggcgggatgaagctccccttctttagacagggaccacagcatacgtgatgacgcgtacagccctgaattggccgcggacagaagcgccgttaaaatgacgaaattcatcagatcggccgcataaggcacgccgactctgtcaaataccgtgacaaacgggctttcaatcacaccggcttccttgatggagatcatccctgacagcacaaaaatcgttccgataaagaaaagcgccagccgccagactgtggtcttaatggcgcgcggaacggttttttccggatcggcgctttccccggcggcgattccgatcaattccgtccctgaaaaggcgaagtttactgaaagcatcgtcatcagtatcgggaaaaagccatttggaaaaaggctgccgccatccgtaaagttcgacagcataggtgcggcctcaccgcttttcatcgggacgaggccgaacatcgccgctccgcccaataaaataaacagtaagatggctaagactttaatgcttgagaaccaaaactccgattcagcaaaaaatttcacggagaaggcgtttaataaaaagatgaaaagagcgaataccgcactccacatccaaactgaagtatgcgggaaccagcgctgcatgaagagcccggccgccgtgaattcagagcccagcgccaccgcccacgtcagccagtacagccatgcgaccgtaaagcccgtcgcgggcccgatataggtcttcgcataggtgtggaatgcgcccgtcaccggcatggccactgacagttcaccgaggcaaagcatgacaagatagacgatgcccgcgcccaaaaggtaagcgaaaatggtgcccgccggacccgcctgatgaatggtatacccagagcttaaaaacagccccgttccgatcacacctccgagtgatagcataaagaggtgtctgcttttcatacttctctgaaaattcgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaggttttggcccaatcggcaatggcttggatgtccgcgggtttcgtccggcagcagcctccgatcaggctcacgccgttttcgtaccagctttgcgcgctttttccgaaatggttttcgcacgctgcgcctttccaggtttttgtcaccgggtcatattgttcaccggagttcggataggcgataatcggtttggatgctgcccgtttgatttcttctatcagcggcggaatatgttcgatcggtgtgcagttgatgccgatcgctgcgatttggctgcaggagtcaagcagggccgcgcattcggaaataggcgtgccttcgctgatatgccgtccgtctttagcgctgaagctgatccatgcataagtgccggggaattcctccagcagccttgtgatcgcttttgcttctgacaggcacggaatggtctcacaggccaaaagatcggcgccggattctatgagggctttcatccgggggcggtgaaagctgatcagctcatcttccgtcagtccgtaatgcccgcgatattcagagccgtcagcgaggctcgcgccgtaaggtccgatagaagcggcgaccaaaggtttgggccggtgtaaacggttttcttcatgagcccaaaattcatcgcgtgcttgtgcggcaagttcaacagatgtctgaatgagacgtatcgcatcggtttccgggatgccgcgcgctgcaaatccttcaattgtcgattgataactggcggtgatcgcgcaatcagcgccggcggcaaaatattctgcatgcacctgtttgatcagttcgggtctctccaaaagaattttggccgaccacagatcgtcatgtaaatcacagcccatccgctcaagctcggttgccatcgcgccgtctatgatcataaccgggtattcatttaatatttgtgtaatgggattcataggccttcctttctgactttactgaaaatatataaaaagggtaatggacgctattctctttgtcaatgaaccggcggaaaaaaggtgttcaggacgctgcccgaacaccttttgtttaggaaatgtgtttgcctttcgcgcttttcgcgctatctgaatactcccagcagtcgatcccgtcatcatcagggagcacatctctgtaaaagacggggtcctttccggctttcttttgccgggcataatcgctcaaagcggcaaacgcttttttcgacagaaggaaaatcgcgattaagttcacgaccaccattaagcccatgaacaagtcagccatatcccacacaagctggactttggaaatacagccgaacagtaccattccgagcacgcagatgcggtaaatgaacagccattttttgttctggcttaaaaatccgatattggtttctccgtaataatagttgcccatcagagcgctgaagccgaacaaaagcattaagacggcaaggaaacctgacgcccacgcgccgacatgatcgctcaaggcagcctgagaaagcgcgatgccgctcagtcccggctggtgataagcgtctgaaaataaaatgataagcgccgtgcttgtacaaatgacgagcgtatccgtcaggacgccgaatgcctgaatgagcccctgtttcaccgggtggctcgtcgtagctgtcgccgccgcgttcggagcgcttcccatacccgcttcatttgagaaaatcccgcgtcttacaccttgcatcaaggccgcacctaaagcgccgcccgctgcctgatcaatgccgaacgcattttttacgattagcgacagaacgccgggcaattgggtgatgttcgtcagaatgacaaagaaagcgacaccgatatataaaacggccaagacgactacgatgtattccgccattttcgcaattcgtttgacgccgccgaagattacgccgccgaaaaccaagattaaaataatgcccaatgtaagccggctggtgccgaatgcgttttgaaaggcgacgctgatcgtattggattgaacggaattaaaaacaaccccgaatgacagtgtgattaatacggcgaacagcgcgcccatccagcgtttcttcaggcctttttccatgtaataggccgggccgccgcggaatccgttttgatcttttactttataaatttgggccagcgtgctttcaacaaagcttgaagccgaaccgatgactgcgataatccacatccagaaaatagcgcccggaccgccgagtgcgatcgcaatggcgattccggtaatattccctgttccgacacgcgccgccatactgatgcaaaatgcctgaaacggggaaatgctgttttttgtccgggcggccgcgccttccttcaaaacccggatcatttccttcagcatgcggatttgcagaccctttgatctgaacgtaaaaaacagtcccagagaaagaagcagtacgattaacagttttgaccataaaaaatcatttgccgagccgattacattttcaaggaattcctgcatccaatcacctcttggttcgtttgattaaaaaatactgagctcccactcctgtgcgatatgtttcagcagcatgccgcctgtcaggctgttgccgtattcatcaatggccggaccgtaaatgccgatgccgcagccgttatgaaaaggctgttctcttctggcgcttgggggaaccaatgccataatgccgccggataccccgcttttggccgggacgccgacgaaagccgcatatttgcctgaagcattgtacatcccgcacgtcagcatcagggctttggcgagtttcgcgacatctttcggaatgacctgttcccgtcggatcggatggtagccgtcatgggcaagtatcaatccgattaaagcgatgtcctcggttgtactctccatggcgcactgctttaaatacacttcaagcgtttcttccacatccgcctcgagaaagtttgtttcttttaaatagtaggcgagcgctcggttccgatgtgcggtctgccattcagaacggaagacctcctcgtgaatgtgaggccgtttccctattaatttttcaaaaacggaaaagagatattctaatttattatgcgccgtttcacccggaagcagcgaggcgacggtaatggcgccggcattgatcatcgggttgaagggcttcccgggtttatggatttcaagccggatgatagaattaaacgcatcacctgtcggctccacgtccacacgatcgagcacataaggaatgcctctggacatgcaggcggcaataaagctgatgacttttgagatgctctgcaatgtgaacgggacattccattcaccggcatgaatcattgagccatccggctctaatatgcaaatgcccagctgagagtcgttgatttctccgagggcgggtatataatttgcgctttttccattgacggaaaacggtcggtaatgctcgacccaatcttgtaaaagtgaagccagttcctctttttcaaggcgctctctgaccatatctttcataacattcctcctctattgcaagcctgtccgaagcggaaaccggtcttggaaaacgttttcaaaaatagcgtgttccatgttaatgtataatgacatctacagaatcatacaaaatacgacaaaatcattcttaaaataagccgatagatttataaatcagccggagtgtcccgccattcgggtctaaagaaatttgcggactgtatcggtcttgttcaaaatagacagaagaaggaagtgattatgatcaggctcgactatttactgaaaaaagacggctatcttttcgcccttatgctgatcaccgtgccgctggcgggggaactgaaattttaccccctgaatgaggtatatcggatcagcttcggcgccccggcttttttcttttttctgctgctgcttcggcatgtgccggcggtattgtcagggctgttgacaggtgcagccgttgtggcattccgaatcggcctggcttgctggggaggagagcatgccggatttacggcggcttttttcagccaatatcccagtttctttttttactttacatatgcctgcttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatatcgcggttatcgctgtttctcacacatttattgtgctgagttttttcaacgtgatgaagctgcacgaatctcaggtcagggaaaaacaaacgagaaagcagcatgagcacatgctgatgattgtatctaacttatatgaagaaacgattcatttgaaaaaaacgttaaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcagcctcgttatccgcatcaatgaaaaatacgccgaatctttaggcaaagacattcaattcaaaagcgtgattgaaggagaacaccccgattatcacgtctttaccgtcctgtcgatcttaaataacctgaccgccaatgccgtcgaagccatgggtgacaggggtgagatccgcctcgcgctgcgcagggctgagggagagatggctgaatttgaggcggaagatgacggtcccggcattccggaaaaaatcggagaggtcgtttatgatcccggttttacgtccaaatacgatgaattcggcacaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataatatgcgtttttttatagctgatgatgaccgggcgatccgttccattttaaaacagatgattgaggacgaggacttaggcgaagtcgtcggtgaggcagaggacggaagccagattgaagggcattatctccatttcaaacaagtcgatattttattaattgatctgctgatgccgggccgggacgggattgagacgatacggcatcttcaggggtcgtacaacggaaaagcagtgatgatatcgcaggtggaggcaaaggaaatggtgggagaagcttattctctcggcatcgaatactttatccataaaccgatcaacaaaatcgagatcgtcaccgttttgcgaaaagtaaaagagcggattgaactggaaacctcgatcggcgacatccaacattcgttaagccgtcttattcagcggaatgaaccgaaaaaaagcgggccgggggggatgcacgagaaatcaatcaaagaaacaggaaaatttcttttgtcggaattaggcatcgtgggagaaagcggggcgcatgacctcatggccgtccttcactatttatttgaggatgaacaggcggaaagaaacatcccgtctttaaagcagatgtttacaaacgccgccattcggaagctgggacctgcggcggcacaagccgaggttaacagagaaatcaaagcctcggaacagcggatcagaagagcgatcattcattcgttaaaccatttcgcttcattgggcacaactgatttttcaaaccccaaatttgaatattacgcctcgaaattctttgatttcccagctgtcagcaagagaatgaaagaaatgcaggccaaggaaaccgtgccgctttctccggttaaagtgaatatgaaaaaattcattcacgtcttttttttggaggcgaaagatttacgcgaaggatcaaaatttgtcagcggaggcagccggtaagctgataaatagggtttacgtatataaggtttttgtgtaaaataatgttaactaagaaggaacggagggatcctgatggctgatcaaattccggttttcgcactaatgaaatagtgtcaaagtctctgccttgagcgcggaggaaaccgggattgtctgcctgaataaggaacctgacagtaatagtgagggggcggcgattatgccgccctctttttggcgtcttcacacatctctttctcctccgcctaaaggcgaagctctgtgtcagtcaataagggaaatggggaaacaagatgacaaaaaaacaaagggaaatagaatccgttttgaacatcgcaaaggaaaatggcttacggttaaaatatgaaggggcggacataaatgaaacgggtatggacttccaagtcgtatttgctgaagatgacaacggcgtgacatgggtgctccgaaagccgcgccgtcccgatgttatcgaaagagcggctgcagaaagcgatgttctcgcgtttctccgcagccatgccacggtatcagtccccgattggcggattcatacaccggaactgatcgcttatccgaaactggacggaataccggctgccgcaattgatctggataagaaacagtatgtctggaatatggaacacgagccgccttcagacggttttgtcggctcgcttgccgcagcattagccgggctgcacggggcagacccggatgcggcctccagatccggaattgaaattataaaaccggatgacgtcaggcaaagggcggcggaatcaatggatcatataaaaaaagaaatcggggtttcagaacagctttggaaaagatggcaaacgtggataaatgacagctcgtactggcctgatttttccgcgctgatccatggcgacttgcatcctccgcatattttgatcggcgaaaatcagcgtgtgacgggtctcctcgattggacggaggcaaaggttgccgatccggccaaggattttgtcctttatcaagtgatattaggagaaaaagaaacaaaacggctgatgaagagctacgaagctgagggcgggcgcgtctggccgaaaatgcaggagcatgtgacagaatggcaggccgcttaccctgtggaaacggcgaagttcgcgcttcagacggggcaagaggagcatatgcaaatggcgcgggacatgctcggcctgtccgatccgaaaggttattgacttccgccggatgacagcgtatgatacattttaaaatcatagaacggatgaacaatgctgaggaagagtaagtacgcatcagcgcgcggggttcagagagtcggtggccgctgtgaaccgatccccgtccggtgccgaatgggcttctgaattgctgcgctgaaatgacagtaggcggtgccgggattctttccccgttatcaagaaaggagtattgaaaccctgagtttctgtactttttgagagaatggcttttcagccgttaataaaggtggcaccgcgaaaacctcgtcctttgatggacggggtttttttgcgttgttaaggaggtgatggccatggaaagtgactggagacggacagacaatcaaaaaaggagggatattcatggtgatcgcaaccgacgatcttgagctcacgtgtccgcattgtgaaggaaccggcgaggagaaagaagggacgccctgtccgaagtgcggcgcgaagggcgtcatattgaccgctcaaggaaacacgctgctgcattttatcagaaagcatatggatcagtgaaatcaaacgaatatgtaaagaaacagcacaaaacaaaaaagcttgtagaaaaacatcgttttctctacaagctgctttttcattcttcaaaataaggattcacatggatgagcacttcttcaacatctgaaaagtgtcttttgatttcatttcggatttcccgggctatatcgtgtccctgcttaatcgtcaaatcatgatccaaagataaccggacatcaagcaatttatagtggccgtgttctctcgctcggattttatcgagccgtttgacttgagggcaatgcaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatttttccccttgtttgatcgaataacgatataagatctgcttagccacgtaggatatcagagccgcaaacaatgcgctgtattgcgggatgcttggaccttcaacaaaggacgaaatcgcttctatcagaatatacacggaaacgagcactaatatgattcctacaatcgcttcgctgatgacctcagctttgccatgcccgaaaggatggtcttgatcgggcggcttattagaaatgccgatgacggccaggacagcaattgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgtcattttttcctcctataaaactgcacaaaaaaataggagcgctcttgattcgctctccgtatcctttcttgtgtaatcactttgcttatcatatcaattcagtttcgagtgggtctatagcaaggttgtttcctgtttactaataaataaggtgacagaaaaaaagttggagcagggctaaatagtacataaacaaaattgcgctgaatttaaaaatgaactgttgacatttgagtatttatcttttattattatcctgaattcaagatattttaattcgagacaatttaattagagtgcaggataagaacctgccgatcgttttgttttttgatcatacattatttgattttttataccataatatctcgaattcgagataaaggggagtgcgagagaaatggctgaatttgtacagctggtgaatgaaagaagatctgcaagcaactttcttccagaacatccaatcacaagagatgagctcaacgaaatgtttgaattggttgcgttggctccatcagcttttaatttgcagcatacaaaatatgtgacggttcttgacccggaggtaaaagaaaagctgaagcaggccgcaaacggacaatataaagtgttcagctcatcagcggttcttttggttttaggggataagcaggcatatcagcaagcggctgacatctatgaaggattgaaggtgctgggggtattaaataaacaagagtatgatcacatggttcaaaacaccgtttcgttttatgaaaacaggggagaactgtttaagagagatgaggcgataagaaatgcttcactttctgcgatgatgtttatgctgagtgctaaggaaaaaggctgggacacctgtccgatgatagggtttgatcctgaagccgtgaaacagattttgaatatagatgatcaatttgaggtcgtcatgatgattacaatcgggaaagaaaaaatagaaagcagaaggccgcgcggctaccgaaagcctgtgaatgagtttgtggagtatatttaaatatttataaaggagcgcataaaaatggctaaaaaaacgatgggaatccatcatattacagcaattgtcggccaccctcaagagaatgctgatttctacgctggagtgctggggctgcgattggtcaagcaaacggtcaattttgatgatccgggtacgtatcacctttattttggggatgaaggcgggaagccgggaacaatcatcacattctttccgtgggcggacgcccgtcaaggcgtcattggagacggacaggttggcgtgacatcttacgtcgtgccgagaggtgctatggcgttttgggaaaagagacttgaaaagttcaacgtgccatacacaaaaatcgagcgttttggggaacaatatatagaatttgatgacccgcatggcctgcatttagaaatcgtggaaagagaagcaggggaggccaatacgtggactttcggagatgtaaccccggatgttgccattaaaggctttggcggtgcaaccctgttatcagcagagcctgaaaaaacaggtgaattgctggaaaacatcatggggcttgagcgagtcggcaaggaaggagacttcgttcgttatcgttctgccggtgatatcgggaatgtgattgatcttaaattaacgccgatcggccgcggacaaatgggtgtcggcacagtgcatcacatcgcttggcgggctcaggatgacgaagatcaattagattggcaaagattcattgctgcgcacggatatggtgtgactcctgttcaggatagaaactattttaatgcggtttacttcagagaacatggggaaatcttatttgagatcgcaactgatccgccgggctttgcccatgatgagtcacaagaaacaatgggcggaaaattgatgctccctgagcagtatgaaccgcaccgggcacaaattgaacaagggctgctgccgtttgaagtaagagaattagattgatttgacacataaaaaataaagaaacatatagtcaattgatgattgctggatggtaccgtccagcaaagaatcagatgaaatcaaagatgaggagagataaaaatggaagatgcaggactattacttattcgaatcatgattggtgtggtgtttctgttttatggatcacaaaaattattcggctggtttggcggatacggaattaaaggaaccggacaatggttcgagtcaattggagttaaaccaggcaatgccgcggccgctttatcaggtctcggggaactcgcaagcggaattttatttattttaggtgtattcctcccgcttggagctgctatcataacgatcattatgttaggtgccattgtaaaagttcatggagcgaaagggtttgcgaacggtgccggcggctttgaatataacttggtgctgattgcagtctccatcggagttgcactcatcggttcaggagcttacgctttgcatttttaatataagtatctaagaacagttactgaaaagcggtaactgttcttttatttttcaagcacgacgttaaggtgctctgaatcgcaaaaaagcggatatgatccatataaatgtgtatagtgaatgtacgagtattgatgagcttggtcatgaaagacgggccgatttgaaggagggttttgatgaaagagctgacagacttacattcattagattctatcgagaattttattaagcagcatcaattcagttttatctacatttcaagacctgcctgtacagtatgtcacgctgttctgccgcagctcagaaaagttttggatcagtttccgaatatcaaattggggcataccaacgctgacgaggtagaagaggtagccggcagattttcagtcttcactgtccccgtgcttcttttgttcattgatgggactgagtttctgagagaagcccgctttgttcattttgaacagctcgaagaaaggctgaaaagggtttatcagttatatcaagatgtataaagcgtttatactttacaatgcgggagtgctttttctgcacctgaaatagatgaatatgtaaagaaacagcaaaaaacaaaaaagcttgcagaaaaaacatcattttctctacaagctgaaggccgctatccggccttttttacattattcggaccggggttctaaaaaacgggaccctcccaagtcttttctcatcagatagatatggaaaaaatattctccgacggcgatgatgacggcggaaatgagagcggcaaacgccagtcttcctccggaaatgcccatggacagcggcattcccatcagccagacaacaagaaacgcgattccgaaatcagcggacgccgccgtgatattattccatctcggaagcacgtacaggtcgcccgtaaagtaggaaacggctcccagcacaatggtcatcagcagcacgtcaccgaatgtaaagcgaaaacctaagccgagtatcagatacagaataatgatggtcataatgcctttaatggcaagcgctttaatgtgttccattcgaattcctccttatggaaatcatgttagtatgtttcctcataacgtgaaatataaacccttttttcgtgaacatttgttttctggcttttggctgtcatcactgggccgctgctgaatatgatgaaaggagaaaatacgggaggtgtcatgatggcagtcgtaaaagcgtcgagcgccgatgtcgatctaatggcaaggctgctcagggcggaagcggaaggcgaagggaagcagggaatgcttttggtcggcaatgtgggaatcaatcgggtgcgggcgaattgttctgattttaaaggcctgcgcaccatcaggcagatggtgtttcagccgcacgcgtttgaagcggtgactcacggatacttttaccagagaccgcgtgaatccgagcggaggcttgcccgcaggaacattaacggagaacggttttggccggctaagttcagtctgtggtactttaagccgccgggcaactgcccgcagacttggtatggccagccgtttgtcgccagattcagatcccactgcttctatcagccgacaggtgagacgtgcgaaaacgtgtacaatacattttaatcccgggggcaccgttcttaaaatgaacggtgtttttttaatgttttgtgaagaaaaataggaaaaaagtgcgcttgacggatgacaagccaaaaagaaacagagggggttttctcccggcggggcaaggtttgtcgaaacaatgtgaaaaatgtctcccgccgttcatttttcagccttacaaacccttcacacttcttcatagcggtttaacatttcttttttataataagggcgatcaatgagacgaaaggggaactgacatgacacatgacggccgtttagatgaatggatcaaggaattggagaacaaaagctttcagaacaatacgtttgaccgccgcgcatttatacagggcgccgggaaaatcgccggtctttccctcgggttagcgatcgcgcaatccatcggcgcgtttgaagtgaatgccgctccgaaattttcaaactatccgttcaccctcggcgtagcttccggcgacccgctgtctgacagcgtcattctctggacgcgtcttgcccctgacccgctgaatgggggcggcatgccgaagcaggccgtgccggtaaaatgggaaatcgccgcagatgaacatttccgtcacatcgtcaaacgcggaacggaaatggccaagccgaatctcggacactccgtccatgtcgaggcggacgggctcaagcccaataaagtgtactattaccggtttaaaagcgggcatgagctcagccccgtcggccggacgaaaacgctgcccgctcccggcgctgacgtatcggccatgacgtttgcatttgcctcatgccagcagtatgaacacggctattatacggcgtataaacatatggcgaaggaaaagcttgatctcgtattccatctcggagattacatttatgaatacggaccgaacgaatatgtgtcaaaaacgggaaatgtcaggacgcacagcagcgccgaagtgtacacactgtcagattaccgcaaccgtcacgcccaataccgctctgatgccaatctgaaagccgcccacgccgcatttccgtgggtcgtgacgtgggacgatcatgaggtggaaaacaattatgccaatgttatccctgaaaaaggccaatccgttgaagcgtttgtgctcaggagggccgcagcttatcaggcttattatgaacacatgccgctcaggcgcatgtcattgccgaacggtcctgatatgcggctgtacaggcaattttcttatggcaatttggcatcgttcaatgtgcttgatacaagacagtacagagatgatcaggccaacggcgacgggaataagccgccttctgatgagtggagagacccgaagcgtacattgatggggacagaacaggagcaatggctcttcggaaatttagccgcctcaaaagcgaagtggaatgtgctggcgcagcaaatctttttcgcgcaatggaatttcggaacaaccgccaatccgatatacagcatggattcatgggacggctacccggcgcagcgggagcgggtcatcaattttataaaaagcaaaaacctgaacaatgtcatcgtgctgacgggtgatgttcacgcaagctgggcgtcaaacctgcataccgattttaaccaaacgaattcaaagattttcggagccgaattcgtcgggacttccattacatctggaggaaacggggcggataaacgggccgatacggatcagatcttaaaacaaaacccgcatattaagtttttcaacgattaccgtggctatgtccgctgtacggtgactcctgcccaatggagagcggattacagagtggtgccgtacgtgacggagccgggggctgaggtatccacgcgggcttcattcatttatcagaaagaccagacggggattcggaaggtctctcaagcggcggttgcaggcggtttaaagcagtcaaacgaggtggaagaggatcgtttcttcgcccataacaatgcgcatgaaaagcaaatgagaaagaaacgggccaaaatctcacaataaggaggcacactcatgttttcaaatatcggcattcccgggttgatcctgattttcgtcatcgctctcatcattttcggaccttcaaaacttccggaaatcggccgtgccgccggccgcacgctgcttgaatttaaaagcgccgcaaaaacattggtctcaaatgaagagccggacaagcagacggctgagaaagacaaaacggcaggatgaatcctgacatgggggcagacgaatccgcttctgcctctttctctataaggaggatgtacgattggataaaaaagaaacccacttgatcgggcatttagaggaagtccggcagcgtctcattaaaatcgttatcgcctttctcgtgttttttatcggcgcctgctggtttgtgcaggatatttatgactggctgatcaaggatttggatggcaggctggccgttttagggccgagcgagattttatgggtgtatatgatgattgcgggaatatgcgcccttacggcagcgattccggttgcggcctttcagctctggcggtttacggcgccggctttgaccccgtttgaacgccgcgccgctttgctttacattccggggctttcgcttttgtttattatcggaatttccttcgggtattttgtgctgtttccgattgtgctcggatttttaacacaattatccgccggccattttgacatggtatttacggcggacaagtattttacctttatgctgaatcttacattgccgttcggatttttgtttgaaatgcctctggccgtcatgtttctgacacggctcggaatcgtgaatccaacccggctggcaaaggcgcggaagctttcgtattttttgctgatcgtcgtctcggtgctgattacgccgccggattttatgtctgactttctcgtcatgattccgctgctcgtcctctatgaaatcagtgtgacgctgtcccgcatcgtttaccggaagaaatgggccgaggcgccgtctgcagcttagtgaagttcgcctccgccggtctcaatatcgtcctcatgcgccgcggcggtcaccgcggcgattttgagcgcttttgtcacgagatccaggctgaggctcggcgcagacttctgcaaggtttgctccggaatgtacgggatgtgtataaacccgccgcggatgtgcggatgatggcaggtgatttcatccatcagcccgtaaaagagatgattgcatacaaacgtccccgccgtgtaggatacagccgcgggaatgccttcctttttgatttcctcaacgatccgtttaatcggaaggccggtccaataggctgcgggaccgccttgagaaatgttttccccgacaggctggtttccttcgttatccggtatgcgcgcctcattcagattgattgcgacccgttccggcgtgatctgcattctgccgcctgcctggccgacacaaatgataatgtcaggctgatgctttttgaccgcttcgcgcagcacggcaagagacttataaaaaacggtcggcacttgttcggatacgatagaggcagggccttcatgagaaccgtccagccgtttgaccgcttcccatgaaggattgaccgtttccccgccgaaggggtcaaagcctgtcagtaatacttttttctccatataaaaccctccttttctttttaccatactctataatggacatatattcctgccgaagggggaaacatgtcttgaattcgcctctggtgcaataccgatctttatttccggtgctccgcacacatacgatgctcgccagctgctctcaaagcgctcttgccctgccggtttcaaaagcggtcaatgactatcaggaaagcctgcttcagcatggcggaaactgggaagaagccattggacgtacggagcaggcaaggtgtgaatttgcgaaattgatcggcgcccatcctgaagaaatcgccgttttaccttcagtaacggctgctgtctctgccgtcgtttctgctttaacggattgccgaaagaaacaggcggtgtatacggaattggattttccggcgatcgcccacattttgaaggcacagactgagatggagctttcagtcgtgccgtctgaagatggaatgatcccgttagagcggtatgagacgtacatatcggagcagacgcttttcacctgtgtgccccatgtgtcatatacgtcggggtttgtccaggatatgaagcgcattgccgagatatccgcaaagaagggatcgcttctttttgtcgatgcttatcaatcggcggggcacatcccgattgatgtaaaagaatggggagttgatatgctggccgcgggtgcgagaaagtatatgctcggcataccgggaacggcgtttctttatgtcagaaaggaacttgccgaacggctgaagccgatagtcaccggatggttcgggcagcagcgggcgtcgatgccggatttaacccgtttttcttatgcggacggagccaaacgctttgagaccgggaccccggcatttatcagcatatatgcggcacaggcggctttatctctattaaacgatgccggcacagaccgcattcaccaagaagtaaaaaaactcagcgcatttgcgtatgaatacgcttctgaaaaaggactgaatctcacagggccgcagtctgccgatgacagacccggcatgatttccatacgggatgaaaaagcggcggaaacggctgcgctgttgaggcggaaaaacatcgtatgcgcacccagcggacaaatcatccggctggcgcctcacttctataacacggctgacgatctgatctatgcgattgatgaactggctgaagcgcgcgatatataaaaaaacagcagactcacggggagcctgctgttttcttatgaatgattcactttgacccgtttcataaagaaagcgctgatcaagccgataacggcgacaatcatcgcgaagataaaggcatgctggacgcccgcaatcagcgcgtgagagtatgcggaaggatcattcgggtttttcgcggtgctcatataattcttctggccggcagccatgatgctgaccgccaccgcagtgccgattgcgccggccatctgctggagcgtattcataatggctgttccgtccgggtaaaattccggcggcagctgatttaagccgttcgtttgcgccggcatcatgatcatggaaatgccgatcatcaggcatgtatgaagcgcgacaatcagaagcgccgtagaagcgccgttaatgtttgagaaaaacgaaagcacagttgccgtgatgacaaacccgggaatgacaagccacttcggcccgtatttatcaaacagacgccccgtcaccggagacataaagccgtttaaaataccgcccggcagcaggatgagcccggacgtaaacgccgtcagcatcagtccgctttgtaaatacataggcaataggagcattgtcgataagataaccatcatacagataaacacaatcacgacaccgagaacaaacatcggatagcggaaagcgcgcagattcatcatcggctgcttcattgtcagctgcctgatggaaaataagatgagcgcgatcgcgccgacagtgagcgaaccgataaccgtcgggcttgaccagccgtctgatccttcgcctgcattgctgaatccgaatacgatgccgccgaacccgatcgtagacagaataatggaaagcacgtcaattttcggttttgtaatgtcagacacgttctgcatgtaggcgatgccgaataaaagagccaacacaagaaacggcagggaaatccagaaaatccaatgccagttcaaatgctctagcacaagccctgaaaatgtcggaccgatcgcaggagcgaacataatgacaagcccgatcgtccccatcgccgctccgcgcttatgcggcgggaagatgacgaggattgtattaaacatcagcggcagcagcagcccggttcctaaagcctgcacgattcttgccgccaaaagaaacggaaagctcggcgcaagcgctgcaatcagcgtgccgataatggaaaaaacgagtgaaacgatgaacagctgtctcgtcgtaaaccattgcaaaagcagacccgataccggcacaagaataccgagaacgagcagatagcccgtcgtcagccactggacggtcgcaggagtgatatgtagctccttcatcagatcagtcagggcgatattcagcgccgtttcactgaacatgccgataaaccctgccgtcagcaaagaaatcatgatcggcatgactttatattgtttggaaggctgagcgttttccaaaatcattctcctctctttctatacgtacatgtctctcgtattttatgtcttcagcaggttggggatttgtttagaaatatggaggatcggcattttgtcttttttggctaaggacacaatgatgccgccttctatcatggcatttagaacagtgctgatttccgccgctttctcatcagaaaaaccggctgatcttaatttgcccgcgaacagattctcccattcctgataagcgttttgacaggcctgccggagcttttcgctctttaaagcagtctcggcagccagtaaaccgacaggaaacccttcaaagttctccggacatgtgaattgccgtgataagtcctgtaaaaacgcttgaatgctttccgccggatcaggatgggcatcaaggctttcttttattttcatacggatataatggctcatttcattgacagcctcaatggcgagctgctctttgccgtccggaaaatgatagtaaagagaacctttcggcgcaccgctttctttaataatctgattcagtcccgtgccgtaatacccctgaagctgaaacagcctggttgctgcggcgaggattttttcacgagaatctccatagctcataatgttcccaccttactgatttgtgacaaatttaaaatatagtgactggtctattatcttgatttcgcatgacggtgtcaaggttttttaacggttattttcttcggaagaatgcctgacaagcgcgttgaccggtgagaggaaaatcatcataaataaagaaaaggagagaaaagaatgaaaaaacaattcatgcccttcattacatttatcacggctctgctcttcatcgcggccggctgctcccaatctcctcaaacgaaagaaacaccgccccagatggcagccgcagcctctgcgaaaaaagacggacttccgaatattaaaattcttgccaccggcggcacaattgcaggcgctgctccttcaaagacgtccgctacggagtacagggcgggggcaatcggagttggtgccctgattcaggccgttccggagataaaagaggccgcgcatgtgagcggagaacaggttgtgaatatcggcagccagaatatgaataacgagacactgctgaaacttgcaaaacgggtaaacaagctgctcaagtctgatgatacagacggcattgtcattacacatggaacagacacacttgaggaaaccgcctactttctcaatctgacggtcaagagtgacaaacccgttgttgtcgccgggtcaatgcggccgtccacggcgatcggagcggacgggccgtccaacttatataacgcggtaaaaacagcggctgcgcctgaggcgaaaggcaaggggacgcttgtcgtattaaatgacagaatcgcttcggcgcgttatgtgacaaaaaccaatacaaccgcgaccgacactttcaaatcggaagaaatgggttatatcggaacaattgctgatgacgtctattttaataacatcatgacccgaaagcatacgaaggatacagatttcaagatagataaacttgataaactgccgcaggtcgatattatatacggctatcaaaatgacggaagctatctctttgaagccgccgcaaaatcaggggcgcaaggcattatttttgcagccccgggaaacggctcaatgtctgatgcggcgctaaaaggcgctgtaaagtcggtcaaaagcgggctggcggtcgtccgctccacaaggacgggaaacggggcggtaacaccgaatcgagagtatgaaaaagaccatttgacagcttcaaactctctcaaccctcaaaaagcgcggattcttctcatgctcgcgctgacaaaaacgcatgatcctaagcggattcaaacctatttcaatgagtactaggagtagagaaccgggtgttctctcctttgtcggtatgccgtattaaagcataagcgtgctttcgggaaaggggcgtctttctcatttttccgctcttttttaattgttgaaaacagtaaaaaatacactattttttccttttcttctctaatagaatgaaaactgcaaaaatattacatagcaggaggaaagttcatgaaacatataaaaagcaaaatcctagtcatccttacagtttgtatgctgtccgtcatttccgtatttgccttccagccgaccgtatcgaaagcctcctcagggcataaccctgttgtcatggttcacggaatcggcggggcgtcttttaactttgcgggaatcaaaacatacttggcatcccaaggctggtcaagaaaagagatgtacgctattgatttcttagacaaaaccggaaacaacagacacaatgcgccgagactgtccaattacgtgaaaaaagtgctcagcgaaacaggtgcgaaaaaagtcgatatcgtcgcgcacagcatgggcggcgccaacacgctctattacattaaaaatcttgacggcggagacaaaatcgccaacgtcgtgacactcggcggagcgaacggccttgtgaccaaccgggcgcttccggggactgatccgaaccaaaagattttatatacatcgatttacagctcagcggacttgatcgttctgaacccgctgtcacgactgatcggcgggaaaaacgtgcagattcacggtgtcggacacatcggacttttgatgaacagccaagtaaacgggctgattaaagaaggtctgaacggcggcggacaaaatacaaattaacagtttcaaagccccggagaatgagaatatcccggggtctttttttcttccatattcttttttcgccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagcaaagaagctgccattccggcagacatcgcggcaaaagaagcgaaacagattcaggaaagcttaatggagtacgcctttacagcacatagagacggcatatcatcatttattaaccagcatgagttcattacggagctggacagacagactaaagacatcggagtcttcaacctcggtatctggggaattttcttccgtccgctggcaggcggcaagacgatttttgaagaatatcttcagaaaaaagccggcggcatcaaccgtccgaaaacacgggaaatcgttgaatcatggaaaagcatgacaccagcggttatggtgcttgaagatgtgaaagaaggaatgattcactttgaagatgtgatgacaaagaaacaattcaaagtggaaatggacgtcagccagcaggatcttccgccggcgggaagcctgattctcggctatccgatccacgaagcggaaaaagcggagttcttcatgcagtttacgatcttccctgtgaagcggaccgaagctctaatcagcaaagtgaaaaaggcggctgccccggcccttgcggaaggaaaatcgcctgagcgctttatgcaggaggacttcgacactgtgctggccgctcttttaggaacggcggaagagcctgagcaggctgctgaagaaaaacagacggagtgggcgaacgacatggagaaggaaacggcggatgccattgaaaaaggcctgagcggggatgaatacccggctgagctggttccggccgttattgacctgtggaaaacgttctgtgtcaaaaaaacaccgacgatcagaaagccggaagctttcgcggcggcggttgaatattacgtaaacagtatttctctgaacggcgcgtccgtttctcaagccaagctggcgaagaagtacggcgtcagcgcctcaacgatttccagccgctataaggaaatcgaaggtgctctcacagatgaagccgaacgcttcgccgcagctctgacatcttaatacacagccaaaaaaccttgaagggcacatgcttttcaaggttttttctgcagaaatgctctcggggcaggataattcttaccggttatctaatactaaacagagcgataaaaggaagggagcctgagccatggatgagacacgtacgctgggcaggacggatttacgggtaaagcgtatcggctttggcgctaatgcggtcggaggacataatctgtttccgaatcttaatgatgaaacgggaaaagaactcatccgcacagcgttggacggcggcgtcaattttattgatacggcgtttatatacggtttggggcgttccgaagagttaatcggtgaagttgtcgcagagcgcggcgtgcgggacagcctcgtgattgcgtcaaaaggcgcgcacaaagaggtcaacggacaaatcgagctggacaacagccgtgaatttctccgtagtgaggcggaaaacagcctgaagcggctgaaaacagacgtgattgatttgtattacgtccacttccctgacggcaaaacaccgctctccgaagtggcgggcacgctaaaagaactgaaggacgaagggaaaatcagagcaatcggcgcgtccaatctcagcttcgggcaattgcaggagtttaacgccgacggttatttagaggtttttcaatcagaatattcactgattcagcgtgaggcggagcatgatctgctgccttattgtgaaaagaacggtatttcttttattccttattttccgcttgcttccggcttgctgacgggaaagtttacaaaagacacagtctttgaggacagccgaaaaaacaggccgccgtttcagggagaagcttttcaccaaaacctggagcgagtggataagcttcgggccgttgcggaagaaaaaggggcgcagacagcgcatatcgcactcgcgtggcttctgtcgcagccggcggtggatgcgatcattcccggagccaaacgccccggccagctgaaacacaatctgggcgcgcttgatgtgcaattgaccgaggatgaggttcaatatatcagtgacatcttcaagtgaaaataaaaaaaggaaatagcctgcgctatttcctttcttgctgtcaggacgttttcaaaaacgcttctgtcaatccttccagatcggcgtctgtatccagataccactggccgcgggcgtttttcttcatctcgatttctcttgttacggaagaagaagccggtttcaggcgcataaactcttccggatagacagaaagcaggtggctgacaatttcgttttcatcagcatcggggtgctttccggcatagtcttgcacgcggtcttgcagctggcccgcgagcggagacatatcaagcggcgtcacttttgcttcaaggacggcttttttgcctgacatggatttggtatgcaccttgagctctgtgttatcccgaagcgctgatgacatggcgtcaataatagcggaaatggcttttgaatccgcctgttcttgtgaaatgcctgcagaagcgataaagctggctttcgccgattcctgatatgcggcggccgtcattttttcatttacaccggtcaggcgggtgaaatctttattgtgcttgccgtacagcatcacatcaatgtatgcggataatgcgtccgccgggtcaggttttgcgtttgaggctgtgcctttgactttcagtttataagataaaggcttcgcgtcttttgcctgcggctgatataccaattcatatgatttgccttcgtcagccgtgaagtacagattgcccgtcactgtcttgcccgcatgaagcgtgccgctctgcatctggtcatccttatcggccgccgctgttttcgcgtcatcctgataaagcgagaagtcgctgcttttgacggtaagcgggtctttgcccgtatttttgacggtgaccgttactttcagcgcggccggatgttcagtatcgtctgaagcggcccatgccgtctcttttattttcactttcgccgtgctgctttcctggccgccgctcgtttcgctgctgcatgcggcggtaaatgccgtgagaagcagtatgaaaaacacggcgctcatttttttgatggacatctggtttaccccctgttgttataatgattaattcaatagtcatgaagacagacaggttaattatactagttttgtataaaagagtcttggtaatcatcaatctttttggaagaaaaggaagtgttatgatgaaaaaagaagaattgaaacagctggctctccggatcggtaacgtacctgcccgctacgagagtaatgtggaagaatatcaggaagatgaggttttgttttggtgggaagataagaatgatccggaagccggcatcatggttgaattagaccgggacggaaaactgaaatccttatcccgtccggctttccggactgatctgccggctctttcggaatcggacatagaagaacggatgcgggcgtttgtagaaacccatcgtcctggggcattggctgagttcgaattggaaaacagcggctccgccaatgatggtgatgtgagatattcctatgttcagatggctgacggtctgccgcttccgctgaccgggttttacgtcgacctgtctttgacaggggaagtaaccggcttttcttaccatgggaagtccgataatctcttaagacccgggacaattgcggacaagcgggaagcattggctcactttgtcaaacatattgaagcggagctgttgttcaccgtattgcatcagtccgtctatgtgcagggggatgacaagcctcatctcgtctatgaaatcgtgtctccgacgcggccgatatcggccgacctgaaggaagagaatgcagaaatagacgaatatgaagagctggaagacggcacgctgccgtatgtcccgatttcatgccctgcacctgaagtggaaaagatgagcatcaatgacatgatcgggctgcacgacggtttttataaagagagggaaagcgatcttggagagggcagtatcggtattgcctggcgtcctgaaaaaacaaaatccgtacgggaagataaaagttttgaaagtctgttaaaagagcggaatgaacatgtattgaaaacaaggtatgataaagaatcgggccggctcaccggggtaatgtcatttatacaaagtgaaggcgaaccggagttttccgaggaagaatgccatcacatggccatccgctttttgttcgccatgtttccggaagcggatcagtatttccgggttcaatatgatgagccggatgatgaaggagaaaacgtgggacttacatataaggcttgttcaggcggcattgatttgcgattcggagaggggagaatctgcgtcagcaaaaagacgggtcttgtcacgttttatatgccgccggaaattgatccgaaagagctcgaggaaattgatcccgttccttcattgacaatggaagaggcgaaggacgcgatccgccgggccatcaaagccgagctcgcttgggatcgttgttacgaagacggcagctgcggaaaagtgtacaggctcgtatataagccggttttcccgcggtttattgaggctcatacgggagaagtgatcacgagtttaataggctgaaggtcatgggcgttcgtcccgggtctttcatgggaaatgtgacttttgtatgggaaacaaccgctctgaatacggctcttttccctctttgctaaaaatagacacataaaaggcactttcttccctttaaaaggataaggacgtttttatataattaaaaacagttcttttttatacactcttctgaaaggatgaccccattgctgaaagaacatctgagaaaaaaagcgctggagatcgggaacataccgccgcactatgagcttgaaatagaagattatgatgaaaaacaaaaaacgagagcctattatatatggaaagatcgtaaccatccggataaaacggtaacgattgagctgggcgacgacggatctttgcttacctattcacgcaacgactgtccgggttcagacatgcagctgtcagacgccgaattaaagctgacggctcttcggtttgcggcgagacaccgcccgcttacttttatgaatttcatctttcaggcgagggaagaacgcaatgggtgcatccgatttatctatacaaaaaaagtgctcggccggccgcttcccgattcaggttttttcgttgatgtaaccaggagcggcttcgtcgtgcagtttatctattacggggataagggtgaagcgcccgtcccggaaacattcgtcgatcgggaaaaagtcgtctcgcattatatgagtgtgctgacattcagtctcgtctatgatgtggtcaattttgagaaaataccgcgtctcgtctatgaaccgattctgccggcttacagctatccggccggtgaagatgatatcgtgccggatcagcagctttgcgaagacaggaatgagccggcaaaaccgcttcccgcgtttgaacataaacgggaaatcagcctggatgaattaatggggtttacctcggatatggttcagacgcgccggcgcgatctcggggatgagatcggaacgacatggcggaaagggtcggttccggaacggaaagatttgagtatcgaaagctattttgaaaccagcaacaaaaatacaatgaagatgaaaacggacaaaaagacagggaaaatgacagcctttaaatcttttattgagcatcagggcccggccttttattctgcggaagagtgtgagaccatcgcgcttcaatttttatacaagctttatccgagagcggacgagttttttaaaatgaacccgctgaaaacggacggaaggggcaggttccgcttccatttttccgtatggcatcaggatattccgctgaggttcggcgctgcgagaatacttgtcagtcccgtaacggggcttgtggaagcttacatggcgcctgacattgacccggagcagctggagaagatcaatccggtgccggccgttactcccgaagaagcaaaggccgcttttttatccgatttccatttgcggctggagtggcagcgcgattttacgccgtccggcaatgaaggatataagcttgtgtacaggcctgtctatcctccgtacattgatgcgcaaaagcgaaaaaagaaaaggttttattagccagggatcatttgtaaatgaggataatctttaaagcctctccaatcgcctccccaatcaaaaccgagcgttttggcaatcgatacgacctcaagccaatcgggcgtgccgtttcggtttccgtcgtacgtcatatcccaaatcaggcttccatcctttttttgcagggcgaagtcgatcgcaaggccgtaattgtggtaagattccccgccttttgcgtaggtgacgatatttcctttttttgaacgtccttgacggtacaattcgttttgttcctcaattgatctgaaaccctctgtaataacgacggtgatgccttttttcagagcggccgtctgcaatagctccgcattctgtttcacgagcggatgaagagcgcttggaatggctctatcttgtaatgccgtctgcggcctcagttctttctgcacataggaaaaacataggtctgcggaaaagaagaggatcaaaagcagcgcaattctgactggtagtttcatggtgaattctctctttctttaattgattaaaatctttgtttgctcactgccataaatttgctatgataaaatataacataattagtagccggaggaaggaggcaaatctatgaaatccaagattccatctgaagaagtggccgttaagatgaatgaatggtataagctgatccgcgcgtttgaagccgataaagctgaagcgctgaagcgggagattcaatatgaactcgaagatatggaagaaaatcaggatttattgttgtatttttcattgatggaatttaggcaccgcatcatgctggataaattaaaacccatgaaagacggcgactgccagcctccgttctctgaaatgctcactgagattgagatgaaccagcaaaagctgaccggcttactggaatattatttttactatttcagaggaatgtatgaatttaagcagaaaaacttcatctcagcgatttctcattataagcgggctgaggaaaagcttgaatatgtggaagatgacatagagaaagccgagtttctgtataaaatttctgaggtgtactatcatatcaagcagactttcttttcgatgaattacgcgggacaggcgcttgatatttacaagaaatatgaattatacggaatgcgaagggtgcagtgcaaatttatcattgccggaaatctgatggacgcccagcagcataaaaaagcgctggaatacctcgaatgcgccttggagcacgcagagcggcttgatgatcaatatatgattgctgcggcctattataatatcgggcactgtatgtacagtctgggtgacttttgcaaggcggcggaggattttgaacgggcggctgccggatttgaagcacacagcttccggcaggtcatccaggctgttttttcactcacacatatctactttaaaacggaaaaatacagtgaagccgccgccagctgcgcgcggggcatgagaagcgcggcggagtgggaagatgagatctatatgacgaaattccgtctgattaaagagctttatcagggggaaggcggacaggattcgctcaaagagtattttgacatcctggaatcaaaggagctgttggctgacacagaggaactgcttcaggacgcggctcatttctttcataaacgggagaactacaaagcggcatcttattttttcagcaggcttgtcggcgtgcaaaaaaggctgcaaatgaacaactacgcataatgaaaaaaagaacgagggagcttcggtttcatcgttctttttatgattccttttgttttcagccgattaaaaccgggtacatgctctgtattaacatcagggaggaaatgagacaatgtatcaggatttacagggaaaaacagcgatcgtaacaggttcttcgaaaggaatcggaaaagccattgccgaacgcttcggcaaggagcggatgaatgtggtagtgaactacctcggtgattccgccggagcggaagaagcggcggacatcattgagaaagcgggaggcagagccgtcaccgtaaaagccgatgtatcctcagaagaagggattcaggcgctgtttaatgccgctcaggagcatttcgggggcgtggacgtgatggtcaacaattccggctttaacggagccgaagcgatgccccatgaaatgagcctggaggattggcaaagggtcatcgacgtcaacgtgaccggcacctttttgggggcgaaagcggcactgaaacatatgctcgagcgcggcaaaaaaggaacggtcttaaacatatcgagcgttcatcagcaaataccccgccctgaaaacgtgcagtactcggcatccaaaggcgggatcaaaatgatgacggaaacgatggcgctcaattacgcagacaaaggcatccgggtgaatgccatcgctcccggcacgatcgccacagagtccaataaggatctggaagatgaaacacataaacaggcccagctgaaaaaaattccgatgaacgccttcggaaaaccggaagaagtcgccgcggccgccgcatggatggtgtcggaagaagcgagttacgtaaccggaacgacacttttcgtcgacggaggcatgacgctttatccgtctcagctggatagttaaaaagaggaggggaaaccttctcttttttgtttagagaagggtcataaaggaaatggttctctaaaaaacaggagggccgcaagatggcgagtgactggtggaaagacgccgttgtctatcaaatctatccgcgaagcttccaagatacgaacagcgacggcataggcgacctgcgggggattatcgcgcgtctcgattatataaaagagcttggcgccgatgtgatatggatctgcccgatttacccgtcgccaaacgtcgataacggctacgatgtgacggatcatcaagcgattatggaatcatacggaacgatggaggactttcacgatctgcttacagaatgccgcagccgcggattaaagcttgtgatggacttcgttttaaatcatacctccacggagcatccttggttcaaagaggcggaaatgaatccggacagcaaataccgcgattattatatttggcggccgggcaccgcggagggcccgccgaccgattgggtgtcggattacggacaatccgtctggcagtacgaagaacatacgggcgaatattacctgcatatgaacgccgttaaacaagccgatctgaattgggaaaatcccgaggttcggcaatcagtatacgagatgatgagattttggctcgataaaggcgtggacggattgcgaatagaccagcttcatcttctgtcaaaaaaagaatacttgccgccatatgaagattacatcgcccgccgggcagatccgaagcctttccggccaaacggagcacggatacatgattacttaaaggaaatgacgaaagaggtattttccaaatatgacgtgatgtcggtcggcgaggccggatcagtgacgcctgaggaggggctggtttacacgggaaccgatgagcatgaactgaatatgatttttcattttcagcatatggagcttgatcaaaagccgggccaagagcattgggatgtaaaaccgcttgagctgtccgatttgaagaaagtgctcacagactggcaggaaaaactggaacatcaaggctggaatacgctgtattggtgcaatcatgaccagccccggatcgtatcccgcttcggagacgaaggcaaataccgaaaggcatctgccaaaatgcttgccgccctgctttatttcatgaaaggcacgccgtacatttatcagggagaagaactcggcatgacaaacgccccgtttgacagaatagaggactatcaagatattcagaccgtcaatatgtatcacaaaagggtatttgaaatgggccgcaacagggaagaagtcatggcgtccattatggcgaaaagccgcgatcatgcccgtacaccgatgcagtgggacggcagcaagaatgccggatttacggagggcgaaccgtggctgaaggtcaatcccaattacaaaaccgtcaatgcggccgaggctcaggatgatcccgattctatattgaacttttacaaaaaactgatccgcctgcgaaaacagtatgctgatatcataaaaggcagctacacgctgctgtttcccgatgacccgcagctgtttgtgtatgaaagacaggcaaacggacaaaaaatcatatccatcagcaacgtatcgaaagaagaagccgccttttattggccggacggctccgaatctgaaagggccgagctgcttctcagcaactatgaaaataacggcggcacggaatcccgcatcacgttccgcccttacgaaacaagagtttatctgcttgcctgatatgtgtgtgatacgacgcccccgtccatacatggcgggggctttttaggtaaatcggttatcaatttagaaaaaaattacttgcaaaacgtaattacttcgttttattatggtaaaggtaacaaatgagcgagaaagtacgattcggaaatcgtcatcattctgatttagagaacagggggaaacggcttgtttaaaaaatggagcggaatcattgtcattgcggcatgctttttaatcgcggcgggctgcggcaattcatcttcaaaaggttcgtcaggttcttcgaaaagcggcaaactgcacgtcgtgacgaccttttatcctatgtacgaattcacgaaacaaattgtcaaagacaaaggcgatgtagacattctcatcccgtcttcggtcgaaccccatgattgggagccgacgccgaaggatatcgccggcattcaaaatgccgatcttttcgtatacaacagcgaatatatggagacatgggttccttcagcggaaaaaagcatgagctctgatcatgcgaagtttgtaaaggcgtcgaaaggaattgacttgctcgaaggttcggatgaagaggaagaggaacatggacacggcggtcatgaccacagccgcagcatggaccctcacgtgtggctcagcccggttcttgcgcaaaaagaggtcaaaaccattacggcgcagatcgtaaaacaggacccgaagaataaagcatactatgagaaaaatagtaaagaatatattgcaaaactgcaggatcttgataaactataccgtacaacattaaataaagcgtcgaaaaaagaattgatcacacagcacgcggcattcagctatctcgccaaagaatacggcttaaaacaagtcgcgattgcaggcctttctcctgaagaagagccgagtgcggccaaactggcggatctcaaaacgtttgccaaaaagcatgatgtgaagatcatctactttgaagaagttgcatcgcctaaagttgcagatacacttgccggtgaaatcggcgcgaaaacggaagtgctcaatacactggaaggtttaagccaaaaagaacgggataaaggcatcggttatatcgacattatggagaaaaaccttgatgcactgaaagattcgctattggttaaataacatagtgtgcgccgcggggtgcacactatttctatgcgggaaaggaaggtcagcatgaatctcgttacattacaggatatcgtttttggttattcgcatacacccgtgcttgacggcgtgtcgctggaaatcaaaagcggcgaattcgtcggcattacaggaccgaacggcgcgtcaaaatcgacgctgatgaaagtcatgctcggcatgctcagaccttgggaaggaacggccgagatcagtaaaaaaaacgctgccggaaaacgcctgacaatcggctatgttccgcagcagatttcttcatttaacgcaggattcccaagcacagttctggagcttgtgcaatcaggccgttatacgaaaggaaaatggtttaaacgattgaacgaaacggatcaccacgaggtggaaaacgcgctgaagatggtggaaatgtgggatttccgccaccggaaaatcggcgatttatccggcggacagaagcagaaaatctgcattgcgagaatgcttgcaagcaatccggatctgctgatgcttgatgaaccgacaaccgcggttgattatgagagcagacagggtttctacgaatttatgcatcatcaggtgaaaaatcacaaccgcaccgtcgtcatggtgacacacgaacaaaacgaagtacagcagtatctggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcatatttcattgtcgggcgtggccatcggtttttttctcagtaccaatattacggcggcgagcatcgttgtcgtcacgatcggagcgatcggcatcgaatatatgcggcgggcataccgtacatattcagaggtatccatcgcaatcttaatggcggccgggctgtcgtttgcgatgtttctgatcagcctgtcaaaaggcggcgcgtcgatgagcatcgatcaatatttatttggatcgcttgtcacggtcagccagcagcaggtctatattatcggaggcattaccctgctgattctgctttatttcattatattaaacagaccgctctatctgcttacctttgacgaggcgacggcgaagacatcaggcattaacacaaatctcctgtcaatgtcattcagcatcgtgacggggctggcgatttcggtcattattccgattatcggcgtgctgcttgtttccgcgctcctcgtactgcccgcggcttttgcaatccgtatcgccaaagggtttaaatgggtgtttgcggcggccattattatttctcttttcagtgtgttcatggggctgacgtcttcgtaccagctcggaacgcctccggggccgtcaatcactttactgttaatcattctgcttctgctcggctttatgctgcaggggatttggaatgcgtttaaaaaaggaaaagaacgaaaaaaccgccgttaagcggtgcagcagtctcatctgctgcgccgtttgacggctttttttacagaaatatatcagcaagacgctcatatgactctttttttgcttcgaaatcaaagacgttgcacagcaccatcatctcttttgtctgataacgttcggaaagttcaagcagacggcgtttcactgcggcagcagagccgatcaccatccgcttcctattttctgcaatctgtttacggtcctccggcgaatacggataagccttcgcttcttccacactcggcacgcggctgtcggcgccttttccgatgcgaagaagccataaatcctggcttaaggcgagttcttccgctttctcatccgtagctgcgcatatgacgaaaatggcacagagtgaggccggagcggaaaaatgggaggaggcccggaaatggtcccgatagatctgaaaggcttttaccccgcgttccggattaatgaaatggccgaagacatagcccgcaccttgaagagcggcgcgtctggcgctgttttccccgaggcccagcacccaaagctgcggggctgtttcaatcaaaggcgctgtttttattccggcataagcatggtccgagggaaccgaatctgtcagaaaggatgataaatcctgaagctgcctgttgaactcggtcatacttttctttaccccgtctgtgagggcgagccggattttcgtcgtgccgcccggtgagcgtccgaccccaaggtcaatccggttcggatgcagcgcctcaagctgacggaaagtttccgcgactttataggggctgtactgtggcagcagcacgccgcctgatccgacacggatggacgttgtggctgcggcggtatgagcgatcataatttccggcgaaacgcttgcgagccctcttgtgccgtgatgctcggcaaaccagtaccgcttatagccccatccttcgctgaggcgggcgagctccgctgaacggcggagcgtctcgtgcggcccgtttcctttggatacgggcgcctgatcaagtatgcttaaatcaatcactcgtctgcccctttcctgacatgtattgatacaaggataggaaaaatgttcagtccccgtcaatttctttgttttctctattctctccggaacgaaggagaatataggaagtaatttttcgccgtttttcgccaaaaattcttatgttttatgaaactttgatataataaaagacgtataacttaataaacaccgggattcttgtcccggaatttagtaaaaatgcgcacttgcggcgtgcttagcggcacccttacagaataggagtgaatcatatggcgatctctttacaaaaaggacagcggattgatttaacaaaaggaaaagccggcctgtcaaaactgctggtcggactcggctgggaccctgtatcatccggcggctttttcggaaagctgttcggcggaggcggtgccaatatcgactgtgacgcttccgtactgatgcttgaaaatgataaaatgacagacagcaaaaacgtcatctatttcggcaatctgaaaagccggtgcggcggtgtcgtacatacgggtgacaacctgacgggtgaaggcgacggcgatgatgaacaaattctcatcgatttggcgaaagtgcccgctcagattaataaacttgtgtttgtcgtcaatatttacgactgcgtcagacgaaaacaggacttcggcatgattcaaaacgcgttcatccgcgtcgttgatcaggctaatcgcgaagaactggtgacttacaatttaagagataactattcaggcagaacgagcctgatcgcggctgaaatctaccgcgaggacggcgagtggaaattcgccgcagtaggagaaggcacaaacgatacaaaaatcggcgatatcgttaaccgatacgcctaaacgataaaaaggagagtgcacacatggcaatttcattggcaaaaggacaaaaagtagatttgactaaaacaaatccgggtctttctaaagtcgttgtcggccttggctgggatacaaacaaatacgatggcggacatgattttgatttagattccagcgtctttctattaaatgaagcaggaagatgcgcgtcgcccgatgattttattttctataatcagcttgaaggcggaaacggctctgtcgcacattcaggcgacaaccttacaggccagggcgagggcgatgacgaaagtgtaagggtcaacctgagcgcggtgcctgccgctattgacaaaatttcattcgtcatcacgattcatgaagcggaagcgcgcggccaaaacttcggacaagtttccaacgcgttcgttcgcattgtcaatgaagagacaaatgaagagctgatccgctacgatctggctgaagatttctcaattgaaacagccattatcgcaggggagctttacagacataacggcgaatggaaattttccgcgatcggctcaggctatcaaggcggactggcccgtattgcgacagattacggcctgcaaatcggctaaaaccatatcaagcacagaagggagagacggcacatggctattcaattggcgaaaggacagcgtgttgatctgacaaaaacgaaccccggtcttacaaaagcggtgatcggcttaggctgggatacgaacaagtactccggagggcatgactttgaccttgacgcgtcggcttttcttgtcgatgcccatgacaactgtgttaatgatcttgattttgttttctacaataacctggaacacccgagcggcggcgtcatccatacgggagacaaccggacgggcgagggagagggagacgatgaacaaattatcgtcgatttctcaaaaatacccgcaaatattgaaaagatcggcatcaccgtcacgattcatgatgcggaagcgcgcggccaaaatttcggacaagtttcgaacgcgttcgtgcgcgtcgtcgatgaaaacagccagaatgaactgcttcgtttcgatttaggggaagacttctcgattgaaacggcggttgtcgtttgtgagctttaccgccatggggctgaatggaagtttaacgccatcggcagcgggttttccggcggtctggcatcactttgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaagggctgctgtcggccgacaatgcgttagtgcttgcggttatggtaaggcatctgcctgaaaaacagcggaagaaagcattaacatacggattgttcggggcatatattttccgctttatctttatcggaatcgggatgctgctcattaagttctggtggatcaaagtgcttggcgcgctgtacctggcttggctcgtcattaagcatttctggatcggagaaggtgatgacgatacggaaggcatgaagaaaaattcatggatggtccgtacgttcggaattttctgggccactgtcgtttcagttgagttaatggatctggccttctctgttgacagcattttagccgcgtttgcggtatcggaaaaagtgtgggtgctcttgatcggcggtatgctcggcattctcatgatgcgtacagtcgcaaaagtattccttgtgttaattgataaaatccctgagcttgaaaacacggctttcgtgctgatcgggattatcgccgtgaaaatggcggcgagcgcttttgattatgaaatgccgcacgtggtgttcttcggaatcatcatcgctgcatttgtggtcacgtttattatccactatttcaacaaacaaaagcaggttcaggagcagacggctgcatctaaagaagaataaaacaaaaaaggagggagagttcatttccttccttttttgtaccgattatcatgaagagaaaggaggaaaatgatgaagcaggaagaattggtgatccgaaaggccgagccggaaaacgatgactgggaaacgtttctgatgcggccgctgccggaacgtcccggttacgagcgggaaaacgggctggcgtttacccggcttgccggccggattttgggcactccttatgatgagacggagtattacagtaagcttttcgagctgtcttctcatgaaaacatccatgtgttgagcgagacgctggataagaccatcgcgccggaaacgtttcaggcgctgcagcacattcattcggtcaatcaaaaagagaaagggctttcggtttccaggtttgtcgcgtttctcgatgggggcaggctgcttgccaaacacgctgatccgcttatgcaccgccggctgaggaccgcgtttatgacgcttttggaaacctttgcggaccggcatgaaaacgggctgaatcatcccgatttccggcgtgtgctcttggatgtgtcaaagttttcgctgaaccacctgaatccatggctcgaacaagccgatatagagtgtgagatgccgaaggtggtgtggtatggagacgcgaccaaaagccagctctattttctctattatctcatgctgatcggctgtgatgtcctattgtttcatccggctgcggaagatccgttcagcttgattgatccggatgaggagctcagctttgtgataaagctccccgcaacaggcggtcttgagccttttccgaaagaaaagccggacagaacgtccacgacggcctaccggtcaacgaaagaaattgagcatgtgctgaaccatgaggaatccatgatgtataagccttggcagttcagggagcacaccccgcagtccgtgaccttaaaaacgacgtatgatgagttatttctcattgcgaaggagcgggcgtttatccggccgcaatttaaagcggacagggagcgggtggccgttccgaacctttttgcgaaagtgatgggggtttccaaagatacgaaagaatattggaacagactccataccgccgcggactatcaggagacacacatgatccgcagttttccgtttacggaagagctgaaagccaactaccagtatcactacagtcaggttttaaatgaaaaaggagagattgacgcggacaggctgaaaagaagcaacatctggcagtacaagcatctgccttcaggtgtgcagagcgccatcgccaatgtgatttctgacatgtgcagaaacccagggctgaaggctttgcccggggagcagtcaagggatgccgcaatctatttgttccgccaggcgacgaatctgcccgcttcgctgctgcaattgattcagacgtttgattacgcccaaaccgttccgaaactcgttttatatcatacggaacaaaatggcgaactcacacgttctgatgccgccgctcttttgtttttaaataaattcggcgtcgatatcatcttgtataatccgccgggccatcaggacattgagcattatattgaagaaagccaatttgatgtccattggctggaggacatggtgtttcggcaggaatataaggagccgtcactcgtaagaaagctgtttagaaccattacgcaaaagcagggagagtaaataaatatgacagaaaatcaaaatccgcttgttcttgataaaaatgaagagatttctgaacaaaaagcagatgacatcagggcgcagctgcgccaagaccctgaggtgcagcgcatttcgcagcagattgacgtgaaaaaccaaatggagctgcttgagtacggaaaagaaccggcagttgaaatctcgaagttctccgaccgcatcttaaatatgatgaaaacaacaagtgtcacggattcaggcacaatgctgacgcagctcggaaaaatcatggaccgtttcgacaaaaatgatttcgatgaaccaaaaggatttctcgctaaaatgttcaaacgcggcaacagcatgattgaaaagatttttcaaaagtaccgcaccctgggcggagaaattgaaaaaatccacgtcgaaatttcaaaatacaaagatgaaatggcaaagacgaaccatacgcttgaagagatgtatgaaaacaacattaactactacatggagcttgaaaaatatgttgtcgccgggcagatgaagcttgaggaaatgcaggcgctcattccttcttatgaagaaaaagcggccggcggaaaccagcttgcgcaaatgcagcttgatacgctgcgtgacgggcttcaggcgcttgaggaacgtgtctatgatttagatatggcgcggatggtggcgctgcagacagcgccgcagatccgcctccttcagcgcggaaatacgaagctcatcggaaaaatcaattccgctttcgtcattacgattccgattttcaaaaacggcatcattcaggctgtcacagtcaaacggcaaaagcttgtggctgattcaatgagcgagctggaccgccgcacgaatgaaatgctgaagcgcaacgctgaaaatatttcaaaccaaagcgtggagattgcccgtatggcaggccgtccgagcattgacattgagacgattgaaacgtcttggaatacgattgtcagcggtatgcaggaaacgaaacagatcgaggaagagaacagacgtatcagagaagacggagcgaaacggattcaacagcttcaggataatattaaaaacgcagtcttaaagaattaacacacagcccgcttgcttacggcaagcgggttttttttgcgaaaaaagataatgacaatgtgtaaagacaggtgtaaacttatacggtaatcattttcgatttgaggtgctgcttatgaaccaacaacctgccgtcactccgcgaaaacttctggcgattgccggaatgggctggctgtttgatgcgatggatgtcggaattttatcgtttattatcgccgcgcttcacactgattggaatttaacacccgatcaaatgaaatggatcggaagcgtcaattccatcggtatggcagcgggcgcctttgtattcggaatgctggccgacaggatcggccggaaaaaagtgtttatgatcacgctgttattcttttctgtcggaagcggcatatccgcttttgcaacgggattgacggtttttctcatattgcgttttctgatcggaatggggcttggcggggaactgcctgtcgcctcgacgctcgtgtcagaagcgtccgctcccgaaaagcggggacggatcatcgtgctgcttgagagcttttgggcagcgggctggcttcttgcggcggtgatttcctactttgtcataccgtcattcggctggcaggccgcactgctcttaacggcgctggccgcgttttatgcgctgtacttgcggaaaagccttccggaatcaccggcgcatcaggcattgacgcagaaaaaaagcatacgcgggcaggcgggaagtgtctggacgaaaccgtatatccggccgacggtgctgctgtctgtcgtttggttctgtgtcgtcttttcttattacggcatgtttttatggctgccgagcgtgatgctgatgaaaggctacagcatgattgagagcttcgaatacgtccttctgatgacgcttgcccagcttcccggatatttctcagcggcgtggctgatcgaaaaagcggggcggaagaccatcttagtcatctatttgctcggaacggcgggcagcgcttatttcttcggtgccgcggattcattggccatgctgctcacggctggcatgctgctgtcctttttcaatctcggcgcatggggcgtgctttacgcctatacaccggagcagtaccctgcggcgatccgcgcgaccggttccggaacaaccgcggccgtcggcagaatcggcggcattttcggtccgcttctcgtcggatcgcttgcagcacggaacgtttcgtttacagctattttcgctgtcttttgtgcggccatcctgattgccgtcatcaccattattattctcggaaaagaaacgaaacagacagagcttgcgcaatgagcacccttttggggtgctttttttagtgagctgtctgttggcagacctatatttttccttaaaatcccttattttcaggaggcgaaaacttctttttccgggacaatgtcgcaaaaaaattcttgtatttgtaaaaaaaggataggaaatcagtttgcagcacattcgatggaaacgttctcaagcctgataaaagcccgatttcctttataatttatcctcaataaggaggattagagagtatttagaagcatatcagaggaaaataagacacagggatgtttttaaagtaatgatacaaaataaacgggattatgatgtttgtttgacttattacaaacgtgttacggtattaaagattgcttattatggagggaaaatatgaatttggatgagaaaccaattaagataaaagtcgaaaatgtatctaaggttttcggaaaacagacaaaaaaagccattcagatgctgtccagcggaaaaaacaaaaaagagatcctgaaagcgaccggatcaaccgttggtgtcaatcaagcaaactttgatgtatatgatggggagatatttgtcatcatgggtctatcggggagcggtaaatcaactttagttcggctgttaaaccggcttattgaaccgactgccgggaatatttatattgatggtgacatgataacaaatatgtcaaaagaccagctccgggaagtgcgccggaaaaaaatcagcatggtctttcaaaaatttgcgctgtttccgcacagaacgattcttgaaaatacggaatacgggttggaactccaaggcgtcgacaaaaaagagcgtgagcaaaaagcgcttgattcgcttaaacttgtcggtcttgaaggctttgaacaccaattcccagatcagctcagcggaggaatgcagcagcgtgtaggacttgcccgcgcattgacgaatgatcctgacattcttctgatggatgaagctttcagtgcgcttgatccgctgatccgcaaagacatgcaggatgagcttttagaccttcatgactctgtcggcaagacgatcatcttcatcacgcatgatcttgatgaagcattgcgcatcggcgacagaatcgtgctgatgaaagacggtaacatcgttcagatcgggacgcctgaagaaattctgatgagcccgtccaatgaatacgttgagaaattcgttgaggacgttgacttatccaaagttctgacagcgggccacatcatgaagcgcgctgaaaccgtgcggattgacaaagggcctcgtgtagcgctgcagctcatgaagaatctcggtatttcttctatttacgccgttgataaacagaaacagcttctcggcgtcattcacgcggcggatgcgaaaaaagcggtggaatccgacttatcgcttcaggatattttaaatactgaatttacgactgtgcatgaaagcacatacttgacggaaattttcgatgtcgtgtctgatgcgaatattccgatcgccgtcacggacgataaggaccgcatgaaaggcattgtcgtaaaaggcgcattaatcggcgcgctttcaggaaataacgattatataaatgttgaagattctgctgaacaagctcaggattcttctgttcagggggtgaagtaaatggacagattgcctagaattccgttagcagatatcgttgaccggtttgttgactggcttaccatgacgttcggaggtttctttgatggaatctcaaacggtttggccgctttcgtaaacgcgattgtgagcggtttgggtttcatcccgtctattttattgactgttatttttgcagctctcgcttggtggatcagtacgagaggaattgcactctttacgttaatcggattccttgttattgattatttgggttattggtcgccgatgctgcaaacgttggcgcttgtcgtcacatctgttttgatttcgattattatcggggttccgatcggcatatgggcgtctcagaaagaaacagtccgccgcattgtcacaccgattctggatttaatgcagaccatgccggctttcgtatacctgctgcctgcaattttcttctttaatatcggggttgtgccaggcgttgtggcatctgttattttcgcgatgcctccgacgatccgcatgacggttctcggtattaaacaggttccggctgatctgattgaagcgacggaagcattcggttcaacgacgtctcagcgtctgttcaaggtacagcttccgcttgccacaaaaacaattcttgccggtattaaccaaagcatcatgcttgctttgtcaatggtcgttatcgcggccatggtcggtgcgccgggtcttggttctgaagtatacagcgccgtgacacagttgaaaaccggtgtcggagtggaagcgggtatcgcgatcgttatcgtagcgattacactcgaccgtatcacgcaaaacattaaagtgaagaagaagagcagggggaatgcctgatgcttaagaaaatcatcggtgtcggcgttaccgctgcgctggctctttctttggctgcctgcggttcgcagactgatgataaggcaacggctgcggaccaggtgaacaaaaccattatcggtatcgatccgggatcggggatcatggccctgacggatgaggccgtgaaggattacggattgaaagactggaatgtcatcacggcgtcaagtgccgccatgacggcgacattgaagaaatcatatgaccggaaaaagccgatcatcgtaacgggctggacgccgcactggatgttctccagatacaagctgaagttccttgatgatccgaaaaaaacgtacggaactgccgagcagattcatacgattacaagaaccggcttcagtaaggaacagcctaacgcggccaaagttctcagccagttcaaatggacgcaggacgatatgggagaagtcatgattgccgttgaggaaggcgaaaagccggccaaagccgcagctgaatatgtgaaaaaacataaagaccaagtggctcaatggacaaaaggcgcccataaagtcaaaggggataaaatcaacctggcttatgtggcatgggacagtgaaatcgcaagtacgaatgtaatcggaaaagtatttcaagacctcggctatgacgtgaagctgacgcaagtggaggcaggaccgatgtggactgcgattgcgacaggcagcgcggatgcgtcattgtctgcttggcttccgaatacccataaggcatatgcgtctaaatataaaggcaaatatgaagatgtaggaacgagtctgacaggcgtcaagatgggtctggtcgttcctcagtacatgaaaaacgtcaattcaattgaagatctgaagaagtaatgaagaaaagcagccctgtaacgggctgcttttttttatgcttcaaacgatttgaggacggcgtccgttaatatctcagcgccagtaaagatggcgcttcggtcaaatgtcatttggggatggtgaagtccaggctccaggccgcaccctaggccgagcatcgtcgttttcaagttcggaacctttaacccgtaaaagtgaaaatcctctcctccggttgtcacaagaggttcatccacatgttcttctccgagaatgctgctgatcgcagatgccatgatggcttccgcctccttgtttcgctcggctgccgggaggctgtgttctttttgcagttcgatttttgcgccgaatgcggcagccgccgcctcacaggctctttcggtttcggcggttaatttctccatggcggcattggtttgtgcgcggagatcaaggctgaacgatgcttttcccggaatgatattggaactttctccgcctgcctgaagctttgtcatcttcacggaatgcgggatgccgggatcaagatgaatgaagctgagtttttggacgagaagagcggcgatttcgatactgttaagcccgagatgcggtctcgcgccgtgggcttcttctccgataatcaggccttctatatgccggcttgagccatgcagaatggacggtgcgcatcggccgtttgccgtttcctgtacggggcgcacgtgcacgccgtataagaagtcaacatcatccagtacgcctttttcaatcattttcagcgctccgccgcctttttcttcagccggctgaaaaataaagcggatggtgcccttcggaagcttcggctgactctttaaaagcatcatcgtgccgagcgccatcgtcatatgtgaatcatgtccgcatgaatggttcgcctgaaagacaccgtccacttcctgccacagcgcgtcaatatccgcccggacagccacaacgggcgagccttctccgatttcgccgacaacaccggtgcaatcatcaaacgtacggattcggcagccggcctctttcagtttttcagtcagatattcagttgtttgatattctttccagcttacttcgggattggcgtgcaggtggtcaaaaatgtccataatgacttgcttttcatgctctgtgagtctgttcatgccgtaagtcctccttcaaaagctgtctgttttttatttttgatattgaaaacaggcaatcggtctgtatataatatagcacatatctgtattttctgaatagtttataaattcaaagcgggatggtgatgttatggctgtgccgaaggccgaacctgtattgaaaaagaaaaaattgtttgtgatgcctgatgcttatgtgctgctgttcattgtcgctttactatgcgcgatagcatcatacatcgttcccgcgggggaatttgacagggtgacaaagggcagtgtgacgtccgccgtcccgggaagttatcattctttagaccagtctcctgtcagcccgatcgctttttttaccgcgattcaggaagggatgacaagttccgcgccgattatttttttaatcctgtttacgggcggcaccattgcgattttggagaaaacgggcgccatcaatggattgatcagtaatgtcatcagtacgttccgcaccaaacagctgctgtttattgcaattgtcggatctctattttcgatcctcggcacaaccggcatcgtcgttaattccgtgatcggttttattccgatcggcctgatcgtcgcccgttcgctgaaatgggacgccgtggccggagcggccgtcatttatatcggctgttatgccgggtttaacgcgacgattttatcaccttcaccgctcgggttatcacaaagcatcgcggagctgccgctgttttccggcatcggcctgcggattgccgtctacatttgttttctgctatcatctattttatatatttatcggtatacgagaaggctcagaaaagcaaaggacgccagtctgctggggaacgattggtttccggcggcaggttcaatcccgcaggcttcagatccggaggacaagccagtcccgtttaccgtccgccataaattgattctggctgtcgcggctttgtcgcttgccggctttttatacggcgcgcttactcttggctggtctgattcagagatggccgccgtgttcatttttatctcaatcgtgtcaggcctgattgcgggaatggcggcaaatgatatcgcaaaaacgtttattacaggctgtcagggcctcgtttacggcgcgctgatcgtcggaatggcgagaagcatttccgttattctggaacacggaaagctgcttgatacggtagtcaatggacttgcgtcactgctgcacggtttcagcccgatggcaggcgcaatcggaatgtatatttccagcgccctgcttcattttctgatatcatcgggctcaggggaggcggtcgtatttattccgattttggcgccgcttgccgatctgatgggcatcacgagacaggtcgcggttgaagcggtcatgcttggggaaggcgtcgtaaactgtgtcaatccgacttccggcgttctgatggccgtactggctgccagcggcattccgtacgtaaagtggcttcgcttcatgattccgctggcgctgatttggtttgtcatcggccttgtgtttatctgcataggcgtcctgatcaattggggcccttattaacatttttgtcaatgatatttcggtttatcattatgaatcggcaagatataatgggagttgtaagccattcttaatagtacgggaggaagtcatgaatcagcgtcggaacagactttcaaacgtgaatggaaagagtgagagtgtgaaagagaaagaacgaatgatttggtcagaagtcggaatgcttgtgggcacactgtctttgcttgacatcatcgtacgcggacttgttctgaactgtccgtttagggaatgggccggaagcttggcggttttcttcattataattgtttattattgcatcagggcgggagcgtcgggaatgctcatgccgagaatagacaccaaagaagaactgaaaaagcgggtgaagcagcagcggatagattcaatagcagtcacttttgcggtggcggcgcttacgatgtacgacagggggtttccccatacattctttgcttggctgaaaatgatctttctttttatcgtctgcggaggcattctgtttctgcttcggtatgtcattgtgaagctgtcttacagaagagcgataaaagaaataaaaaagaaatcatcttgacaggtggtttctttttttgtttgaaagcgggaagtctttttaattgataggaatatagatttgaattcactctgccgcgttgctttgatagagagagtgtgataagttgaaatgtaagcgttaacataattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggcccggcggctgcaaacgctgaaactgcaaacaaatcgaatgaggtggccgcgtcatcggtcaaaaacgggaccatccttcatgcctggaattggtcgttcaatacgttaacacaaaatatgaaagagattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaaatatggcgtaaaagtcattgttgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaaacctatctgaaacgtttcttggaaagagcattgaatgacggagcggacgggttccgctatgatgccgccaagcatatagagcttccggacgatgggaattacggcagccgattttggccgaatatcacaaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctcccattatgcatctgacgtgtctgcggacaagttggtcacatgggtggaatcacatgatacgtatgccaatgatgaggaagagtccacatggatgagtgatgacgatattcgtttaggctgggcagtgattggttcccgctcaggaagcacgcctcttttcttttccagacctgagggcggaggaaatggtgtaagatttcctggaaaaagtcaaataggagatcgcgggagcgccttatttaaagatcagacgatcactgcggtcaatcaatttcacaatgtaatggccgggcagcctgaggaactctcgaatccgaatgggaacaatcaaatattgatgaatcagcgcggctcaaaaggcgttgtgctggctaatgcgggatcgtcttctgtcaccgtcaatacttcaacgaaattgcctgacggcaggtatgataatagggccggcgccggttcatttcaagtagcgaacggcaaactgacaggtacgatcaatgccagatccgcggctgttctttattctgatgatattggaaatgcgcctcaggtctttcttgagaattaccaaacgggggcagtccattctttcaatgatcagctgacggtcaccctgcgtgcaaatgcgaaaacaacaaaagccgtttaccaaatcaataatgggcagcagacagcatttaaggatggagaccgattaacgatcgggaaaggagatccaatcggcacgacatacaacatcaagttaaccggaacgaacggcgagggtgcagcgagaacccaagaatacacgtttgtcaaaaaagacccggcccaaaccaacatcattggctatcaaaatccggatcattggggccaggtaaatgcttatatttacaaacatgatggaggcggggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccgggcagaaccagcccggatttgattatgtgcagaatggtttgtataacaactccggtttaaacggttatcttccgcattaatggatagggctatcatcacatcagcgtgccggcaaaccctcgcttctgggaaaaggacagcacgtcttcaatcacgctgaaaagatacaacatcctaaaacggttccgttttaggatgttgtcaacaatctggaaaccatcatcgatattttttgtccaaaaatcaaacttttctcttgcaaaagtttgtgaagtgttgcacaatataaatgtgaaattattcacaagttaaaaacagacaccacgaaacactggaggatgagcatacatgatgaacgaacgagtgaacaaagtagcattaatcggagcaggttttgttggaagcagttatgcatttgcgttaattaaccaagggatcacagatgagcttgtgatcattgatgtaaatagagaaaaagccatgggcgatgtcatggatttaaatcacggaaaggcatttgcacctcatccggtgaaaacgtcttacggaacatatgaagattgcaaggatgccgatatcgtatgcatctgtgccggagccaatcaaaaaccgggcgaaacgagacttgagctggtcgaaaaaaatctcgccatttttaaaagcattgtcggtgaagtaatggcaagcggatttgacggcatcttcctcgttgccacaaacccggtcgacattctcacttatgcgacatggacattcagcggtctgccgaaagaacgcgtcatcggcagcggcacgacactggattctgcgcgattccgttatatgctgagtgaatatttcggagccgctccgcaaaacgtacacgcccacattatcggcgagcacggcgataccgagcttcctgtatggagtcacgccaatatcggcggagtgccggtgcagcagttgctggagaaaaatgcagcttacaaacaggacgagctggatcagatcgtggacgatgtgaaaaacgccgcctatcatattattgagaaaaaaggcgcgacatattacggagtggcgatgagcctcgcccgcatcacaaaagcgattttgcgtaatgaaaacagtattttaaccgtcagcacatatctggacgggcaatacggtgtaaacgacgtctttatcggcattccggctgtcgtcaatcggaacggcatcgccggtgtgacggaacttgagctgaatgaaacagaacagcgtcaattcaaccatagcgcaaacgtgctgaaagacattctcgctccgcatttcgcggagtaaacaaaaaagcagtacatgacaaacgccatgtactgctttttttaattcgcttttttcgccatttcctgagaggtttttactctcgcttttcccataaacaaaatggtaacggccgcaatgacgatcggcgccagcgcaagcgtgaatacatatgtgatgctttgcgacatggcgtcaataatgcgatccagaatgtgcggcggaatatgggcgcgcgtgccggcctggaaaatctcctgcggatttccgatgttctgcatcgcgccgcccgctcctttcatgccgctgaatgaatctgtgagcttgttggtaaacacattcgtctggatggtcccgaaaatcgtcacaccgagcgtcataccgaatgatctcaaaaacgagtttgttgagttggcgcttccgcggtaacgcggctccagatcgttcatggacgcagccggcagcagtgagaagttgaagccgacgccgaatcctgagatcagcatgaataccgtcagcatcgtacgcgccgtatccggtgtcatattggaaagcagcagcattccgataaagaaagcgaccacggaaatcagcattaaattgcggaaccgcactttcgtctggaaaattccgccgatcatacttccgataacagaaccgatcatcatcggtgtcaaaataaagcccgcgctcgtcgcggtgctgccgtacacagcctgaacgaaaatcgggataaataccgctaaaatcacaaatgtggctccgtaaaggaacgccagaatctgtgccgtggcaaataaacggtttttaaacatccaaaatgagataatcggttcttccgcttttctttccacgataaaaaaggcgataaagaacacggcgaacacagcgaacagaccgatgatctgaacggagttccaatcatacgtttttccgccgagctcaagagcgaacatcagaccgacaatggaaaccaccagcgtaatcgcgccggcccagtcgattttctgcttcttgtgttcaagggattctttataataacgaagaatgaaaaacaatgataaaataccgatcggcacgttgatataaaacacccagtgccagctgatggagtcggtaatgagcgcgcctaaaagcggcccgagaacgctggaaaggccgaaaacggcaccgaacatgcccgacatttttccgcgtttttccggcggaaataaatcaaaaatgatcgtgaaggcgatcggcatcagcgcgcctccgccgattccctgaatgacgcggtaaataatgagctgatccattgtttgagcgatcccgcataatgcagatccgattaagaaaagaataagaccgaataaaaagaaacgcttgcgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaacttcgtcgaggcgtccttcgcggctgtttgttccatgctttttcctcccatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctgtttcatcaggcggccgctcaatctctcggtctgtttccgaccgatttgaaatcagctgatatcttaaatgaagcaggcccgatgaccgcaggcgagctcgggaaaaaaaccggcctcagcacaggttcggtaacggcgctcattgaccggctcgaaaaagcgggatatgtcatgaggaaaaaagaccccgaagacaaacggcgggtgatcatcgtgccgctgacagccggaaaagcgaatgtgaagcaattgttcagctccttatcccagtccacgatcagcctttgccggcaatataaagaagaagaactgcggctgatattcgattttttaggaaaagcgacggacatgatggaagacgagcttgagaaattaaaataatgtatcatagcacggtccattcatgaataacttgtacaagttgcatgaatgagggggaagccaatgaacatctttttaagctacatcgttctcgggctgtcattgtcagcacctgtcggaccggtcaatgcggcgcaaattgacaaaggcatcaaaaacggcttttggcatgcatggattttcggtctcggcgccatggccgcagacgggctgtatatgattctgatctatttcgggctgtctcaatttttgaccgctccttttgtaaaaacgtttttgtggctcttcggttttttcgtgctgacctacacgggagtcgaaacgttaaaaaatataagggaagccatgaatgtcagaagcggaaaaggaaaaccggctttttacaaaactttcggcgcggggttttttatttctctttccaatccgctgagcattttattctggctcggcatatatgggagcattctcgccaaaaccgctgaatccttcgatgcaaatcagcttttgatttacagctccggcattcttctcggcattttgatctgggatttctgcatggcggtcgccgcgagcactttcagaaatctccttcatgaaaaagcgctccgctggctgacgggagcggcgggtgtgtctttgatcgttttcgggttttatttcggatggcaggggattcaaatgctcatctcataaatagaagagtcacccatcgcctgtctccgtcataacgtatcatgacgatactggaggtgggccgatggcaagcgggctgtacacaaaaagttgccttgaggaaaagttattggatctgccaaattggcagagaatcgcttttgagcttctatcagaaaaagtaggcgataaagcggacgcgtttccgtgcattccgggacgtcagggatttttgacagatcagctccggatatcctttgcgggtgatccccgcgaagagggaaccccggaggaagtggggatgctgctgtccgagtacggaaagatctcaaggaataccggaaaatacgcgtcgctgcttgtgatttttgatacgcctgaggatttagctgagcattattccgttgaggcgtatgaagagctgttctggtcttttttaaaccggctgagcggctgcgacccgaaagactggccggaagacataccggaagaccctgaacattataaatgggagttctgctttgacggcgagccgtattttattctgtgcgcgacgcctgcgcatgaagcgagacaaagcagaagcttcccgttttttatgctcgcgtttcagccgagatgggttttcgaaggattaaatgattcaaccgcgttcggacgaaacatgagccggctgatcagaaaacgcttagaggcgtatgatgaagcccctcttcatccccgattggggtggtacggaggaaaagacaatttagaatggaagcaatatttcctccgtgatgatgagacccaagtgtcaaagtgtcccttttcttatttgaagagactgtttaaaccgacgaaataagctatgatccggcagggctgtgtccctgctttttttgtacgatccatgtcacgatcgcaatgacggcgagaaaacaaaggctgaccagaaaaccgggccggctcgatttctcaaacagcgtcccggagacggccgcgacaatcagcacaagggcgataacaatctgtacggttcccatctttgtcgtttcgagcagtttcttgcccgagaacaaaatgaacagccacgtataaagaagcatcagtcccgccgcggttgtcatgtgttcatatatatttttcggcagcaccaatgacaggatgatggagacgatgagtccggcaaacgtcaatccgagcgcaggccagcagatttttttgttttcctttaatctgaagcatttcggcgcatctccgtcatcagccattgtacaaagcaatgtcgtcacggcaaacagcgaggcgacgagcgtggaaaatcccgcaataataaaaatcccgttaaaaatatcaagaatgatatctaaatgaaaacccttcagcgaagtaataaacgggctgtcctgttcagtgaatttgcccagcggcactaacagcagcgccaggccgagagaaatgacgtaaatcaccgcaagaacggcaagcatcagccggcctgattttgaggcttcctccggctttttcaaatgcacggtcatcagccccaagacttcaattcctccgaaggcgtaaaacgcataaatcaatcccgtccataaccccatcgctccgtgcgggaacaaatcctttgattcgttcggcacctgcacatccggtttatgagaaaatataccgcacagcgccaatatggcgatgacgataaacataacaatcgccgccgtcttgacaacagcgagcacattttccgttttttgaaaaacggacagccccgtaaatataatcaaaagaccgagcaccgcatagatggaggcgaaaatccacagcggcacattcggaaaccaatgcttcgtaaaaagcgagatcgctgtcagctggcttcccgtgatcagcatctcggacgaccagtacacccatccgttgctgaaaccggcccaagtgccgaaagcctttctcgcataagcgcaaaaagaccccttttcgggctgtttagccgaaagtttcgcgagctgctcaaagacaaaataggtgccaagcccggcaataagaaatgagatcagcgcggaatatccgcttttgacaatagcgatgctggacccgagaaaaaagcccgtcccgattgtgcagccgacgccgattaaggagagctgccaccaagcgagatttcctttaggctggtcctgtgatttactcatgaagttcaacccctttatcaaagcttagattgcggccgtcagaaggggaatatacatccaataaattgctttacatgaaacaaacggccggagttcataatagaagaaaaaaaggagcagtctgatgacacagcaatttatcgtaccgccgaaaaaagggctaggcctgagggttcacaaagggcagattataaaagtagtcgatgtggaagggcagcaggtggctgattttacggcgtatcatgccaaggacttttatgaacatcttgatcagggcgcgacgatcgatgccaaccagtccattcatgtaaaaacgggtgatcatatttattcgaatttatacaagccgatgctgacgctgattgaggatacagtcggcaagcacgacttgctgcttcccgcctgccgtccggatatgaacaggcttttatacggaaagcataaagacgagctccaggatacgtgctatgacaatatgagcggggcgcttgaaccgttcggggtgccgcggccgcatatgcattatccatttgccatctttatgaacacggtgctcgatgagaaggggaacttatcagtcgaaacccctctttctgacgcgggtgattatgtacggctccgtgcggaaatggatctcgtcgtcgcgttttcatcctgtccgatcgaaaaagggaaatgcaacggggacagcatcacggcgctgcgggtggaaatcagctgatcccggtgtatttggttcacttaaaaactgcacctgtgctatatttaacaaagagtcgtacatagtggcatgattcattttcagtatgaacgggaaatgaatcataaagaaacaatgcaggaggagtgattgggatgagcatccagaaacaaattatgaatgatctccatgtaaaaccctcaattgatccgaaacaagaaattgaggacagagtgaactttctgaaacaatatttgaaaaaaacaggtgccaaaggctttgtgctcggcatcagcggggggcaggattccacgcttgcgggacgcctcgcccaattggcggctgaaagcatcagagaagaaggcggaaacgctgaatttatcgccgtccgccttccgcacggcacacagcaagatgaggatgacgcccaattggcgctcaaattcattaaacctgataaatcatggacatttgatattaagtccgctgtcagcgcgttcgctgatcagtataaaaaagacacgggcgatcagctgtctgactttaacaaaggaaatgtaaaagccagaatgagaatgatcgctcaatatgccatcggcggacaagaggggctgcttgtcatcggaaccgaccatgcggccgaggcggtgaccggtttcttcacgaaatacggtgacggcggagctgatctgctgccgctgaccggattaacgaaacgccagggcagacgtttattagaagaactcggcgcgccggaacgcctgtatttgaaattaccgacggccgatctgctcgatgaaaaaccgcagcagacggatgagaccgagctcggcatcacatacaatgacattgatgattatttagaaggcaaggatgtttcttccgaagtgattgaagcgctggaaaaacgctacctcagtacggagcacaagcgccaggtgccggcatcgatgtttgatgattggtggaaatagaatgaaaaaaacctcccttttgaaagggaggttttttgtttatttcatttttatttatctacactttcataaatccctacccaataccctttgctgctgtcatagtatttgtatttaaaaatccatgttgtaccattcagttcgaaagaagcagcgaaaataccgttagggcttggaacgggcttgatggcattaatgccggcatctgctttcgttgagattgggctattttccacggatggggatgctgttggtgatgcggcaaaggcaggagcggcagacatcagtaaggcaagagacagcgcagaaccggttaacacttttttgaatttcatttcgaacactcccttttcaaatgaaatgtattacagtgttaataattagacgattatccatataattccttctttatttctaaaatttttttcttaatttgaaaaaacaccccttcagaggggctttttatttattgatccatttgcatggatcagggacatgttttcaaaacgcttttttatttgatacggatatgattcagcttcaccattaatttgtcggtaaatcttcgaaggctgcctctcgaatcaggcttaagaggcagatttgcatgggcagcgatcgtttctgcggcctgctgaatagacatttggtctgtatggagatgttctgtgaagaggctatcagacaggctgttgatgcagcggtcgatttgttttgcggcccaggagttttttccttccgctctggtgcgcaggcgtttcagcaatgtttcctttgaagccagcagggtaaagtggtgaatggtccggccatcctgtctcagcctgctgataatgtcatggaagtattgatcgttcgtaatggtcatgggcacaatgatgatgccctgatatgtatctgacaaataggaaagcatgctgtaattgaattcccgccacagagggtagctttgaaagtcatcttcagcgatatccggcggtatcatcgaacgcatcgcaaaccccatcttttcaggatcatatacgtaagacggtttcagtcttctgtgcagttcaaacgctgtttgtgtttttccggaaccgaaagccccatttatccaaatgatcatcatgatatccccctttttctatatgatacaaaaaaaagacccttcgatcgaagagtcagcgggaaaaaacagacgtatattcccggagcgattcctttatatgcgtaaaggcatgttctccaaaatactcaagagaaacaaaaccgtcatattgtctgttcatcagctcttttaaaaatgctttttgatcgagatctccttggaaaatcggagttggcttgctgagataccagttgtcaaaattccagtgatagtttttcagatgaatatggctgacggtatgatacagcttttctaaagcggacatttggtcaacgtgattgacgtgtaggttggagccgtcaaaaatggtgcggacccgcggatgtccgacatcctccaaaaatgccagtgccgcctccggtgtatccgcgtacgtatcgtaatgaatctcaagcccgatatcgacttcatagtcatctgcgagccgtgccgcctgctgaaattgatcaaccgcacgttgccacttttccggtgacgtccgatgcgaaggaagattgccagcaaagactctgatcaaggggctgtgcagctgtcgtgccgcgcttaatgccccttgaacatcctttaacgcctgcctttcatcctgagcggcgaagtcagtgtacaaactgacggcaggcaccccgaggccttcctcctgaagctgctgatcaagcctgtcgagcgggccgatttcctctatatattgtttagcgtgtccgtaccacagttcgattccgtcaaaggagtgctccttcgcgaaagaaatgatgtcgaaaatatgcttttttttaaatcctgtcgtgcaaaaactcagtttcatcggtaatcctcccgtaactgtctatcatatgtgtacttttccccgggtgagatacggataaacaggtgaaaagggcagacacttttataagcggagtgtcagtgcggcgcacaaattgtttagcgcttttttgcgtcaaagtattaaataattgaccgaagtgttgtacaattaatttcattcgagtaaggggggagaagccattgaaaaatgaaacggagctgacggacttcagtcccgtccgcaataaaccgactcgcgctcgttatgtgatactgtttcttttgttttttatcactgcgattaattatatagaccgtgccagtgtatccatcgccgccccgtccattcagacatcgctgaacataagccccgcgcttttgggcgtcgtcttttccgcattcagctggacctatacgggtatgcagattcccggcgggctcattttggacaaattcgggtcaaaacggacgtacggcgtttctttaatgatctggtctgttttcaccggagtgcaggcttttgcagccagtttcggatttttattcggctgccgcctgattatcgggctggctgaatcgcctgcgtttccggcaaacaaccggattgtcacgacatggtttccaaggcgggaacgcgcctttgccacgggtgtttatacggcgggggaatatgtgggactggcgttcgccacaccggttttattctgggtgttaacggcatttgactggcgcgccgtctttatttcctcaggggtgctcgggcttgttttctccgttttctggttcaaaatgtatcacgagccgaatcggtaccggaaagtgaaccgggaagagcttgattatattagagaaggcggcggactgacagaggtgtctgaatcagccggcaggatcacgtggcgggatttcgtccagcttcttaaataccgcaagcttgtcggcttgtatatcggtcaattcgccgtagcctccacgctgttcttctttttgacatggtttccgacttatctggcggaggcaaagcacatggcattcttaaaagtcggcttcgccgcatcaatcccgtatatcgccgcctttttcggcgtattgttcggcggatattggtctgacggaatgatgaaacggggcgtgtcggtgaacgttgcccggaaaacccccgtcatcctcggtcttctgctgacaggctccatcgtgctcgcgaatgttacggattctgctcctgcggttttgacgatcttatccattgcttcttttgcgcagggcatgtccaatatatcctggacgatgctgagtgaggtggcgccaagcgaaacaatcggattggcaggaggcgtgtttaactttttcgccaatatggccggcattatcaccccgcttatcatcgggtttatcgtttctgcgaccggttcatataacggagcgattctgtttgtcggcgctgtcgcatttatcggggcattttcttatattttcattgtcggaaaggtggaacgcattacgctccgatagaaagaaaaactcatctcttcttataaaggatgggttttctttcattgcattatctctatatttcaatattgggttatcatataataaacataactttttcatttcttaggaggatttcgccgaagatgaacgcaaaacgtgccattcccgtaagagaaagaaacatcgtactgatcggattcatgggtgtcggaaagacaacaatcggccagctggtcgctaagaaattatacagagacttcattgatattgatttgcagattgagaaagatttcaatatgtccatccctgaaatgtttgagaaaaaaggtgaagcctttttccgtcagaccgaaaaggattatatattagatatctgccgcaatacgaaattcaagatcgtgtcacttgggggcggttcgtttaaacaagaggaaatcagacagtgctgccttgaaaactgtctcgtgctccatcttgatttatcatgggagaattggaagcagcgggctgacctgctgattgaaagccgtcccgttctgcataaccgttccatggatgaaatgcagcagctctttaacgagcgccaaagcatctatgataaacataattcaaaagtggcgacggataatctggaaccagaagaaatcgccgattatatcgtagaaacgttaaaaatcggctgggatctgtatcagccgatgtaaaaagagccgtgacgctgtgagcgtacggcttttttgttttcttttaaacaaacgtttattaaaatgtttagaaaatgagtgtaaaatcgtgttaagatagagtcagaaaattaaatcttataaaacaaaggagaataatcggatatgcaattatacgacttgccgctcgaccaactgcaaacctataaaccaaataaaaccgctcctcatgacttttcggatttttgggcatcatcattacatgagcttgcaaaggtagaggcaaagcctgaattgacggctgaaagctacccggctgacggcgtgaaagtattccggctgacataccgaagcttcggcaaggcggaaattgagggatggtacgccgttcccgaccggcaaggaccgcatccggccatcgtgaaatatcacggctacaacgcgagctatgacggggatatacatgacatcgtaaattgggcgcttcacggatatgccgcgttcggcatgcttgtccgcggccagcacagcagcacagatacaagcgtttcaccgcacggacacgttcccggctggatgacgaaagggattttagataaagatacatattattaccgcggcgtgtacttagacgccgtccgggctttggaagtcatcagcggctttgatgaagtggatgagacgagaatcgccgtcatcggggggagccagggaggcggactttcaatcgccgcggcggcactatctgacattccgagagcggttgcggccgattatccttatttaagcaattttgagcgggccattgatgtcgctcttgatgagccgtatcttgagattaactcctttttcagaaagaacggcagccctgagacggagaaggccgcgatgaatacactggcctattttgatatcatgaatctggcggaccgcgtaaaagttccggtgctcatgtctatcgggctgattgaccgcgtgactccgccgtcgacggtgtttgccgcttacaatcatctggaaacggaaaaagaattgaaggtttaccggtatttcggacatgaatacataccttctttccatacggaaaagctggcctttctgaaagcgcatctgaaaggctgacgacagcgaaaagcccaagtacttgggcttttttcaggaatgatcacggaaaaggacggatacagatgaaacaaaggatcatcgaagaattaaaacgaattgaagcacagcacggcgtcaaggtgctttacgccgtagaatcagggagccgcgcatggggatttccgtcaagcgacagcgactacgatgtgcggtttctctatgtgccgaaaaaagaatggtacttttcgatcgaaccgcatagggatgtcatagaagagccgattcatgacatgcttgacatcagcggctgggaactgagaaaagcgctgcggctttttaaaaaatcaaatccgcctcttttggaatggctctcttctgagatgatctattatgaagctttctcagcggctgaaaagcttcgaaaactgaaaatccgcgccttttcgcctgaagccggcatttatcattatctcaatatggcaaaacggaatgaaaaaacggaattgcagggcagtgaagtgaagattaaaaagtatttttatgttttgcgtcctctccttgcctgcagatggattgaaacgttcggctccgtaccgccgatgtcatttcccgtactggccgatgccttattgacggatgaagcgctcatttctgaaatcaatacactgcttacaaggaaaaaaagcggtcaggagctggctccggaaccgagaaatacgatcattcacggttttatagaagaagaaatagaacgcatcgggcactatgtcaaaacgatcaaaacaccgaaacctgacataacggaggaactgaatcagctattgattcagaccgtcgaagaggcgtggggggaaaaaggcggaaattgacgattgccgtcatttccgtccgccttttttcggcataatccgcctgctatctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttatccaagagcagctttctcaataagatggcgcgaagctggggaagccgtgtggcagccggcaaaatcatcggaggaatggatttccgcagttctatcccgacaatccgacatttgaacagccaggggctgtcagttactgtcgatcatttaggggaatttgtcaacagcggtgacgtcgcgaaagaacgcaccgaggagtgcatgcagaccatcgccttaattgctgatgaacagctgaattcccaagtgtcattaaaaatgacgtctttaggtcttgatatagatctcgatctcgtctatgaaaatatgacgaaaatcctccagacggctgaaaaacataaagtcatggtgacgattgacatggaagatgaaacgagatgccagaaaacgctggatatctttaaagacttccggagccggtatgaatatgtaagcaccgtggtgcaggcttatctgtacagaacggagaaggatcttgatgacctcagcccgctgaatccgtttctgcggcttgtcaaaggagcctataaagaatcggaaaaggtggcctatcctgaaaaaagcgacgtcgatgaaaattataaaagactcatccgcaaacagcttttaaaaggacattatacggcagttgccacgcatgatgacaaaatgatcgagtttacaaaacaacttgccgaagagcacggcattccaaacgaccgttttgagtttcagatgctgtacggcatgcgctcgcaaacccagctcagcctggtggaagaaggataccgcatgagagtctacctgccttacggggatgactggtacggctatttcatgagacggctcgccgaacgcccctcaaacatcgcattcgcctttaaaggaatgactaagaagtaaaaaagggagagatgacaatgactacaccttataaacacgaaccattcacgaatttccaagatcaatcgaacgttgaagaatttaagaaagcgcttgcgacggtaaatgagtatctgggaaaagattatccgctcgtcatcaacggtgaaaaggtagagacggaagcgaaaatcgtatccattaaccctgcagacaaagaagaagtcgtcggaaaagtgtcaaaggcgtcccaggagcacgctgagcaggcgattgaagcggctgcgaaagcgttcgaagagtggagatacacatcccctgaagaaagagcggccgttttgttccgcgcggctgccaaagtccgccgcagaaagcacgaattctccgccctgctcgtcaaggaagccggaaaaccttggaatgaagctgatgcggatacggcggaagccatcgactttatggaatactacgcgcgccagatggttgaattggcaaaaggcaagccggtcaacagccgcgaaggcgagaagaaccaatatgtctacacaccgaccggcgtaacggtcgtcattccgccatggaacttcctctttgcgattatggcgggaacgacggtggcaccgatcgtaacgggcaacacggtcgttcttaaaccggcaagcgcgacaccggtcatcgcggcgaaattcgtagaagtgcttgaggaatcaggtcttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcgaaagtgcagccgggccagcagcacttaaagcgtgttatcgctgaaatgggcggtaaagatacggttgttgtcgatgaggacgcggacattgaattggcggctcaatccatctttacatcagcattcggcttcgctggacaaaaatgttctgcaggttcacgtgcagttgtccatgaaaaagtgtatgatcaagtattagagcgcgtcatcgaaatcactgaatcaaaagtgacggcaagccctgacagcgctgacgtgtatatgggacctgtcatcgaccaaggttcttacgacaagatcatgagctacattgaaatcggaaaagaagaaggccgtttagtaagcggcggcaccggagatgattcaaaaggctactttatcaagccgacgatcttcgctgaccttgatccgaaagccagactcatgcaggaagaaattttcgggccggtcgtggcgttttctaaagtatcaaactttgatgaagcgctggaagtggccaacaatactgaatacggtttgacaggcgcggtcattacaaataaccgcaaacatattgaacgggcgaaacaggaattccatgtcggcaacctgtacttcaaccgcaattgtacgggagcgattgtcggctaccatccgttcggaggcttcaaaatgtccggcactgattcaaaagcgggcggcccggattatttggccctccacatgcaggcgaaaacaatcagtgaaatgttttaagagggactgaatgggcatcctcctcgcggggggtgtccatttcaccataaacatataaagcggaggaggaaatgccatagcaaacattcagttgattatttccatttgtatttatatggcgggcatgctgtttatcggttatttcgcctacagacggacgtcaaatctgacggattacatgctcggggggcgttctttaggccctgccgtcacagcgctcagcgcgggggcggcggatatgagcggatggctcttgatggggcttccgggcgccatgttctcaacgggattaagcggcgcttggattgtgatcgggcttgtgctcggggcgtgggcgaactggcttttcgtcgcgccgagactgagaacgtataccgaaaaagcggggaattccatcaccattccgggtttccttgaaaatcgtttcggtgatcatacgaagcttctcagactgttttcgggtctcgtcattctcgtctttttcactttttacgtatcatccggcatggtgtccggaggtgtcttattcaacagcattttagggttgaattaccacacgggactgtgggtcgtgacaggcgtcgttgtcgcctacaccttgttcgggggctttttggcggtaagctggacggactttgttcaagggatcattatgtttgcggcgcttattcttgtgccgattgtgacgattttccatacgggcggcccgggggaaaccgttgccgatatccgttccgtcaacccggaactgtttaatatgttcaaagggacgaccgtcctcggcattatttctttatttgcgtgggggctcggctatttcgggcagccgcatattattgtgcgttttatggcgatcacatctgtgaaagagatcaaacgcgccagacggatcggaatgggatggatgattttgtctgcactcggcgcgctgtttacgggtcttgcgggaatcgcgtattaccaccagcgcgggttgaagctggctgatccggaaaccatttttattcagctcggcagcattctgttccacccgattattacgggatttctcatttctgcgattttagcggccattatgagtacgatttcgtctcagctgctcgttacgtccagttctttagtagaggatttgtataagtccatgttcaggcgttcagcttctgataaggaactcgtatttctggggagaatggcagtgcttgcggtgtcaatcatcgctttagtgctcgcctgggagaaaaacaacacgatacttggtcttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccggtctttcagactttttgtacgaaatcattccgggctttgctgtaagccttgccgctgtatttgtcgtcagcttattgacacaggctccgtcaaaagatgtcacagatcagtttcatgactaccgtgatacactttctcaataaaagcaaggaacgagaggaagaagggaccgccctttttcctcttttcacgatacaggctttcggatcattccgttttgggagtatatgaatttttttctatacaaaaagtcacccctcagagtatgataaagataaaaagagcataggagaaataggtatggaagagcttttagagagagttttttcatttacggacattgataaattaattgatttcatcagttatgaattgcagaagcccgttattctggaaagcgcggatttctttttgcttgcctataattcttattacattaatcacttcgactccgccaaccagcagacgatattctcaaaaaaatgccccgtgcagatttttgaaaggtttctgaaggacggggtgatcgaaaagctgaaaaccgttcctgaaccgttccgtgtcgaaaaaatagacagtatcggattgaatcagagagtggttgtaagcgcaaaacataaaggggaagtgatgggctacatctggattcaggagctcgaccgaaacttgacggacgaggagctcgattttttatatgaaacttcattccatgtcggaaaaatcatctacaaaacgaaccggctgaaacaggaaaaagaagagagagcggaagacctggtgaaacgggcgatctttcagcaattctcctctgaaaaggagttcaggcgggaagcggaaaagatgaacgccgtgctgccgtcggttttttcggtagtcgtcctgcacgccgcgaatggggatggggaggcagtcgaagatgtaaaggaaaatatcaaatcgtacttgaatttgcgggataaagtcagccacgtcttaaccattgattccaatattgtcatcgtcgtcgcaagcttctcgcaaaaaagctccggcacttcggcagcatctgaattcatccacaaactgctgactcattttcactttcagaagatccccactcccatctatatcggaatcggcaatgaatacagcagcatcctgaagctcggcaaaagttatatagaagcccttgaagttataaaggccgccgaaattaccggaaaccaggaaaatatcccgtacgaatacagtaagctcgggatttaccgctatcttgaaagcatcgaagaaaaaaacgcctcactggaatatgtaaacgatgatttagcgttattaaaagccaaagacagagaaagcagcactgaactgctgaaaacgttagaaatctatctcctcaataactgcaaaacaaaaccagccgcagaacagctttttattcatcaaaacacattgaactaccgcatcaaacagattcttgacatgacatcaattaatttaaacgacttcaggacaaggtgccagctgtatctcgatatcatgctgatgaaaaagagataaaaaagaaaccagtcgccgtactggtttcagttttaataccttcccgcttatcaatctcagaacctcacttctgaatcactcctttcccgcaagatgagaaatgaataaacactgctcctcaatatatgttatactttcattgatattgattctcaattaaaaaagtatgaagtatagatataacgggaggcacaacgatggcggaaaatcatgaggtgtacgacgtcacgattataggcggaggcccgatcggcctgtttgcggctttttattgcgggatgcgggagctgaaaacgaaagtgatcgagtttttgccgcggctcgggggaaaggtgtctatgttttttcctgaaaaaatcatccgtgatatcggcggaatacccgggattgccggggaacagctgattaagcagctgaaggagcaggcggcgacatttgagccggatatcgtgttgaatcagcgggtggccggatttgaacggctggaagacggaaccattgtgctcgaaagttccgaaggggaaaagcactatacgcgcacggtgattttggccgtcggcttggggacgcttgaggtcaatgaacttgacagcgcggatgcgagccgttattcaggaaagaaccttcattataaggtggagacgcttgatgcgtttcgagataagcatgtcgtgatttccggagggggagataccgcggttgactgggcgaatgagctggaaccgattgcggcgtctgttaccgtcttgcaccgccgtgaggagtttggcggtttggaaagcagcgtggcgaaaatgaagcggtcttccgtgcgggtgcttgcgccgtatcgtctgaagcatctcaacggcaccggggaacggatcgagagcgtcaccgtttgccaaactgagtccggactttctgaagtcatcaagcttgatgagctcattatcaaccacgggtttaaaattgatctcggtccgatgaaggactgggggcttgagatagaagaaggcagaattaaagctgacagacatatgcggacgaatcttccgggcgtgtttgtcgccggtgacgccgcccattatgaaagcaagctcagattgattgccggcggtttcacggaggggccgaccgccgtgaacagcgccaaagcctatttggacccgcaggcggaacagatggcgatgtattcgactcatcataaaaaattggtgacacaataaaaaagggctgacccccgatgttgagcccgggggtcagaaaaagcattccggcgtatcagctgtgaacgagcatgtctttcatttcatttcgtataaacgcaaataactgttcctgatttttcacggcggtaaacccccagccggcggggacgtcttcgcccatgcagatgacgggagggcggtttcctgacgggtccggtgatatgccgatttgttttccggcgctgatcaaatgctgagcggattctttgcccgtacagataatcatttgcagaggtgactcactgatcgtgcgttcgatcatggaagtgaatcgctcatccgcgatatgttcatgggtgatataaaacgggcatgtttttgagtctggcaagttttctgctgcttgacggctccctacaatgagagaatgcggagaatcattttgccattcggataggagaaagccccgttttgtcagttccgtctttgcggcttcagtcgctgcattcaggcttgcggtcacccggcggatgtcgatctgcttgaaagccagtgtgtcaaagaattcgcataccgcaaggcgtgatgtgaaaaatagttgttcaaaggtgctgatctgtttcaggatgttttcgtttgcgggcatttttttaacgatccgcttcggccattcaataacttcggcgccatactcgcgcagcttgtctgtcaatgtatgttcatcatccccatgagtgaccaccatgatatgccgtccgatgaacggtttgctttcaaaccagctgtgtgtttgaaaattgacaatatcaccgatgacgataatggcagggttggtgatgttttggctttgaactttttcatggatatcctgaagcgttcctttaacgctccgctgccgtccccacgtcccccattgaatgacgagtacgggaacggaaggggattttccgtactccataagcttccggcatataaatgacagatttttaacgcccatgtaaaacacaagcgtttgaacgcttcgggcaagcccttcccagtcgagattcggcctgccgtgcaatgatgtatcatgagcggtgatcatcgcgaaggacgaagcgaaatcacgatgggtgacggggactcccgcatacagcggcgctgcaattcccgcggtgatgccgggcaccacttcgtagcggatgccatgctgatgaagcgcctctgcttcttcgccgaccctgccgaacacacttgggtctccgcctttcaagcggacgacggtgtagccctccgccgctttttctatcagcagggcatttatctcagactgtttcataaaatggcggtcgggcagctttccgcaataaatgaaccggcagtccggtgaggcgtattctagaaactttgggtttgcgagccggtcatacaaaatgatatccgctttctccagagcctgttttccttttacggtgatcagccccgggtctcctggtccggcaccgacaaagtatacgattccgtttttcatgatggcgtcatcccttcagcaatttaaaaaatgaaggaccacttggaaaagtgatccggtctttgatcaatacaggaggtatacattctctccttcgatcagtgtttcgtatgttttgacacagccatgatccggctcttggacttttccgtcttctaaggaaattttccagtcatgcatcgggcagaagacgtattctccgctgacgatgccttcagccaggacgccctctttatggggacagcggttttcgacggcgcggacgctcccgtcagaaagcttaaatacggcaagctctttatcttctatatatacggtttttcctaactcctcgggtaattcgtttacattgcctatgcaaacctttgtcatatctttattaaccatgtccgttcccccttactgttttatgaagtcgtgacgacattttcgaatagatctttagaagcttttttatctttaaggaagtattgccacggatctttgtggacagagagtgtctcattcattctgtcgttgagctcctgccgtttttccggatcgtttaatacggattggacatgagataaaccgacgcgctcaagccatgcggatgtccgctccagatagtttgccgtttctctgtagtactgaaggtaagcacccgcgtattctaagacttcttcattcgtttttactttcatcagcaaatcaccggcgcgcaaatgggttccgccgtttccgccgacataaagctcccagcctccgtcgatgccgacaacgccaaggtccttaatgcctgattccgcacagttccgcgggcaggcggacacggccattttaaccttatgaggcgtattgagcccttcgaattttttctcaagcgcaatacccagtgccatggagtcttgtgtgccgaagcggcagaattgttcgcctacgcacgtttttaccgtgcggagtgtttttccgtacgcgtagcctgacggcatatcaagctcggcccatactttcggcagatcttcttttttaacgccgatgagatcaattcgctggccgccggtcattttaacgagcgggatctcatatttgtcgacgacatcggcgatcttgcggagatcttgagagttggttacgcccccgtacatccggggaacgactgagtatgttccgtctttttgaatattggcgtgcatccgttcgttcacaaaacgggatgttctgtcatcctcgtatgtagccggattaatcatgcctaagtagtagttgagggcaggccggcatttggagcagccttccggcgttttccagccgagcacgttcatgatttctctcgtatgtgagagccctttggctttgatttcttctacgacttcatctctcgacagtgaggtgcagccgcaaatcgcttctttttgcgcggatgagtcaaattctgagcccagtgtatattgaagaatgtcttctacgagcggtttacagcctccgcaggaacgggatgccccggtgcatgctttgatttcgtccgttgatgtgcagcctttttcctgaatggcttgaataatggcaccttttgaaacgccgttgcagccgcagatgatttcatcgtcgctcatcgccgcggtcatgcttacgcctgcttcctgatcaagaggctgtaagattgatattttggaggtttcagagatatctgcttctttttgaatcatagaaaacaggcggttgccttcgctgctgtctccgaacaaaacagcgccgacaatttgattgcccctcaggacgatttttttataaatgccgtcctgttcatcgaacacttttattgcctttttgtcctctgattcatcaaagtcgccggcagagaagacctcgacgcctgatacctttaattgagtggagagaacggagccttcgtacggttttgtttcaatgccgcaaatatgtttggccagcacttttgcctgttcatagagcggcgccacaagaccgtacgcgattccgcggtgctcggcacattcaccgaccgcgtaaatgtgcggaatttcagtctgcatataatcgttgacaatgattccgcggtttaccgggatgccgctttctgtgccaagctgtgtattcgggcggatgccgaccgccatgacgaccagatcagcttcgatgcttgtgccgtctttaaagcgtacgccttcgacacggtcagtaccgagaatttcttcggtttgtttttcaaggaaaaatgtcatgccttgtttttctaactcgttttgcagcaggcgtcccgccgctgcgtcaagctggcgctccatcaggaatggggcgaggtggatgacagacacgtccatgccgagattcagcagtccgcgcgcggcttccaaacccagcagtcctccgccgatgacggctgcttttttatattgttttgacgcggcgagcatcgtgtcggtatcttttatgtctcggaatgccgtgacgccttgtttgtctgcgcccggaatcggaaggataaaagggacagagcctgtcgccaggatgagttcatcgtaaggctggattctgtctgcatcggtgatgacggtttggttttccgtgtcgactttgatgactgtttcaccggtatacagctgaatgttgttttctttgtaccagttccaatcgtttaacgtaatgtcttgaatgtcggtatcgccttgcagcacttttgacagaaggattcggttatagttgggatgaggttcggccccgaatattgtaatctcaaattcgtcttttgaaacacgcagtatttcttcaatcgctcttaccccggccattccatttccaacaaggactagctgtttttttcccatcagatgatccgctccttatctttgtttttttcagcgtagcacagcaaaaacaaatatttaagatgcatgttatgaaatgtaacaaaaaatacgaaaaaatctaaaaattttatgaaaattagatagggatgattcgtaccgcacacatcttaaaaccgggcattttacagtccggatccaaggcttcaccaattaaatcgttgacgttttgcgtgtcagaccaatggatggggacaaacaacgtgtgatgtgtctgacttttacttgattttaaacggagaatacatcaaaataaatagtaacgattgcgatttaaaactatgtacatcatgatgaaaataaggcagttgcgagatataaatcgtaatcattctattttatcagggggctattgatatgaaaaaaattccggttacagtattgagcggctatcttggtgccggaaagacgaccgttttgaatcatattttacaaaaccgcaacggtttaaaaattgccgtcatcgtcaatgacatgagcgaagtaaatatagacgcgggcttggtgaagcagggaggcggtttgtcaaggacggatgagaaacttgtagaattatccaacggctgtatctgctgcacgctgcgtgaagatttattagtcgaagttgagaaactcgcgaaagacggcaggtttgattatattgtcattgaatcaacagggatcagcgaaccgattccagttgcccagacattttcttatatagatgaagaaatgggcattgatctgacaacattctgcaggctggacacaatggtgaccgtggtggatgcaaaccgcttctggcatgatttccagtccggtgacagccttcttgaccggaaggaagcggcgggagaagaggatgaacgggagattgccgatttattaattgaccaaattgagttttgtgatgtgctcattttaaataaatgcgacatggtgggcgaaaaagagcttgaacagctggaaacggttcttcgcgcattacagccccgtgccagactgatccggtccgttcgcggagaagtgcccgccgaatgcatattgaataccggtttatttgagtttgaggaagcgagttcatcagcaggatggataaaggaactgacggcaggtcatgaagcgcacactccggaaacggaagagtacggcatcacttcgtttgtgtactcgcggcgtctgccgtttcataccgttcgttttgacagctggctgcatcaatcaatgcctgacaacattgtgcgcgcaaaaggaattgtttggtgcgcaacccgcaacagccttgcgctgctgatgtctcaggcgggtccggcggtttcgattgagcctgtttcttattgggtggcggcaatgccgaaacttgagcaggagcagatcaaaaagcaggaaccggagattctggaagattgggacgaccaattcggagatcgtcatacgaacttggtgtttatcggaacagatttagatgaagccgccattacaaaggaattggatcagtgcctgctcacgcagtctgagttcgattctgattggtcgcagcttgaagatccttttcaatgggatattcagcgggccgaataacataccggccaagtttagaagcaggtgaaaagggaaggagtgatgaaaaaggagctgaccaagtgtgaaagcattgacataccaaggaaaagaacatatggaagtgaaagaagtcccggcacccgccattcaagatgagagagatgtcatcgttcgaatcaccgcaaccgggatatgcggttcagaccttcatttatataaaaacggaatacccgccgatccgggttatattgtcgggcatgagccgatgggaatcgttgaagaaacgggcagtcaagtcaaaaagctgaaaaaaggcgaccgtgtcgtgattccttttaacatcggctgcggagaatgtcattactgcaagcaccagatggaaagccagtgtgatgaatcaaatccaaatcctcatacagatgccggcggtttattcggtttttcggagtttaacggtaattatcccggcgggcaggctgaatatttacgtgttccttttgctgatttctcttcttttctggttccggcagacagtgagcttgaagatgagcaggtgctgcttctgtcagatgtcatgccgaccgccttttggagcgttcagcacagcggagtgaaaaaaggagatacagtcgttattttgggatcaggtccgatcggcttaatggcgcaaaaattcgcgtggaaaaaaggagctaaacgggttatcgcagttgatcaagtcccgcatcgccttgaacatgcgagacgcataaacggagcagagaccttcaatttttcagaacatgatgagatcgggaaactgctgcatgaacaaacgtcagggggcgcggatgtagtgattgattgtgtcggaatggacggcacgccgctttcaaaagaaaaagcagagcaaaaaccgaatcagttcggaacgatcagcccgattcttatagcatcagaagccgttaagaagtttggaaccgtgcagctcacgggcgcatacatttctgaagcggacggctttccgctcggtgatttttttacacgcaacgtttctttaaaaatgggccaggcacccgttattcatctgatgccgatgctgtatcaaatgattgaacaaaatgaaattgatccgacggatatcattacacacaaaatgagtcttgcggaagctcctgctgcatatgatatatttgacaaaaaagaagatggcgacattaaagtgattttgaagccatagcgaggggaaacatgatgaatatttacagaccggcgggattttggatcagattgggagccgttgtactcgactatttaattacttcagtgcctttggcgattatttttatgctggcaacaggaaaagacccgaatgagagcgcaatgatcagcatcattttgactctttatggtattttgctccctgtatactggaacggttatgttatcggcaaaaagatctgcggtatccgcatcgtcaaaaaagacggaaaccaggcaggctttcttactatgattttgagagtgcttgtgggcggcctgatatatggcgtgacgtttggaatcggtgtgatcgtgagcgcattcatggtcggaatgagagaagacaaacggtcaatccacgattttgtagcgggaacgtatgtcacatacgcactgccggacgaatcgattgaaaagagcgaataatttcgctctttttttgcataaaaaatggatgagggagcaacatataacaaacgttaaaggaggaaagagtcatgaaaaaagctgcattgtctttagctgcgtttttcattacagcaatggttttcacaatgccggcacacgccgaaacaaaaatgccttcaacaatgtcactcacggaacagcagaaacaagaaattgaatcacttgaaaaagaagtgctcgaaaaacgcaaacatgtcatatccaaatatgttgagtacggggtcctgccgaaagaaaaagcagaacatattaaacagcatatggacaggcgctttaatatgatgaaacaaaatggctttgtcccgaagcctccgcctcataaattggaaaagcggcatcatcattcttaagcatccggcaagccggatgcttttttgtttttatcgggattgctctgaaatgcgtttcaaaacgtatgatatcaatatcatacgcatcaggaggatgaaacacatgatacataaaaaacagggtctgttccctgatacatttctatgggggtcagcttcggctgcctatcaggttgaaggagcttggaataagacggtaaaggaccttcagtatgggtgaactgtgcagagaggctattagtgacggagttcatctcatcggctgctgcagctggtcattcacggatctgtttaagctggctgaacggctatcaaaaacgctacggttttgtgtatatcaatcgagatgaagaagatgaaaaagacttgaaacggatcaggaaaacagtttttattggtaccagaatgtaattgaaacaaacggtaaaagtttataaaagttccctgagagaaatatgattctctcaggggtttcttttacattgcgtctgcatcaataatatacgtatccgcatgaagatcggatatttcggcaggcactgaataacaggtaaggctgtatcggcctttcggaatattaaagaaaagccgctttgacatcacgctttcaatctcaattccatcttttacagcctcaaagggaacagtcgcttttttctcataggatagtaccggttcacttgtgttaagcctgaagacgataaatgccctcgtatttctccttgcttcgaatgaaacagctccgtcagcttccgcatatcctttttcaatggcttcatcggtccaatcgataacaggcggttctgaatctttttggaagattgtaaattgatgatacgaaatggccagttcttgcggtttccatgatttattcaatgcgctgttcctcctgtttttttacttgattttaaataatactctcgttccgtcgggatcattggtaagctggtgtccgacccaagagccggctccgcggttgtctgccggagaaatatattctacggaggcattgtttccgccctgtttacaaaccgccatcggccattcatccctatcgtatcccgttttgacaggcacatgtttaagagattgctcacgccgcttatgtactccgtctctgtcaatggtgcatatgctggaatgcccttcttttatcgcgtccttaatatgctttgctgtttccggatatcgatcggacggaaataggattactttgtcgtaatcactcttctgaacggtctgctcgttatctgagaaaagatcacccttgatcagggccgcgactgctccggcaatgatgataagaacaagcagcagtgcttttaatgttttcaagagtatcaatcacctccagttttaaattgctgtaaagctggtccaagaataaagcagaatcggccggctgtaaagctgttaaaatatatttctcagccgcaattcagctgaatatctgtaaaaccatccgcacaaatcaattttattcattaaatatccgatcagaaagtgttttttgccgtttccctattcagaaatgaacggttgcggccgtatcgtcaattgacttattatagcgataagctcaccggcaggatatcttcgtctgcgagtgtccgacccgaaaaccttggcctgcatgaccgtgcgcaacaagacgataaaaagacggccatctgataagaaggccgtcagtaaatcattccagattcgcatgctttgtaaacatgtctgctgaattcagttcttttttctccatgatttttagaataaccgcatcgtaaaacagcagaagagtttgttcgaataaagaacccatcggctgaatcgtctttctgtctccgccggtctcttccttaggagagccgggaatcgttatcgtaagatccgcaagtttgccgagacttgaatcggggttaatcgttaatgcagtgatgatgccgttaaggcttttggctttttcagctgtatgaagcagactttttgtttcgcctgagcctgagccgatgatgacgagaccgccttcttggaggggaggggtaagcgtctcaccgacgatgtaagcgttcaggccgatgtgcatcatcctcatggcgaacgctttagccataaagccggaacgccccgctccggacgtgaagatttgatctgccgataaaatctcatctgcaagcttgtcagcttcactgtcggctattaatgctgcggtgcgggatatttcattgagtatttcatgtaagtattcagtcgttttcatgatccttgtgaaatcagctgtttcattttagcagcagcatccgctttattgtcagctcccgtaatgcctccgccgacaatgattaaatctgggttttgtttgatggcttcaggaagcgtatcaagtttaatgcctccggcaattgcggttttagcgctcttgaccgcttttttaatcgccgtcagttcctcgaatgaattctttccttctgcttgaagatcataacctgtgtgaacacaaatataatcaacaccgagttggtcaatttcttttgcccgtgtttcaaggttttttacgttaatcatgtcgacgagaatttttttctgctgtttttttgcttcggcaaccgcccctttgatcgttgagtcgtctgtcgctcctaaaacggtgatgatgtcggcgcccgcttctgccgctttcatgatctcgtagccgcctgcatccatgattttaagatcggcaagcactttcaggtgaggaaaggctgatttcatttcctgtacggctttcaggccttcattaatgacaacgggagtgccgatttctacaacatctatatattgttcgacctctttcacaagttcaattgcttccgggatattcactaagtctaatgccagctgtaattccactttatatccactcctctttttcatgtatttacattctatagagtgccccgcatgttgagaagtacgcactttgaagtctaatagttactttgaggatactgtccccgcaggcaatgcgctttgtttcagcaaaactgcgtggtagtataaactgatgaaagttgtgtaaaaaagtaagcgtgtatgaatagatgatgaacgtacaaaaagtaagaggaaggagaatggcccgtgagccgaatggatgagaaaacgtttaattgcgaaaaggaattgacgcttgccgtgataggcgggaagtggaaaatgctgattatgtggcacctgggaaaagaaggaacaaagcggtttaatgagctgaaagctttaattccggatattacgcacaaaattcttgtgaatcagctcagggagctggagcaggatctgatcgttcacagggaagtttaccctgtcgtccctccgaaagtggagtactcattaacggagcaaggagagacccttatgccgattttggacgccatgtataagtggggaaaagaatatatggaattaatcaacattgataaaactgcaataaaggaatctttttgaagcgctctatgtaaaatagagtgctttttttgcggtttaatgaaatcatattgcgaacgattaaatctcctgtttcggttcttgcgctgttttttccccatcagctcatatatgaaaactattttcattctgccataactggatattcgagagatttatactatagtttaaagatttttaattttacataaataatatttttaaaaataaattgcgggatgccgcaaaataccctctggaattgtcggaatttttttcggtgtgccgaatgaaacttttcacccatttttcggtgataaaaacaataatttcatataaagtgaacgtaagtagatatatagtaattcatgaagaaataggtaaaccctgttgcttacaaacattggattcttgtcttgatttctcataaatttgagccgcatttcggactgtgcgggtgagtggattgcggatttcggcggtgattgaatcgggatcgttttggaggtaagtggttcttttggcttgataatgagttagggacattgagggaggctgtttctaagggagaattgacaattttatcttaaaaaggggaggcgcacacatatggaaataactttttatcctttaacaaatgctcaaaaacgtatctggtatacagaaaaattctatccgaacacaagtatttcaaatcttgccgggttcgggaaactcatttctgacgacggcgtacaggctcattacgttgagaaagcgatacaggaattcgtccggcggtatgagtcgatgagaatccgtctgcggcttgatgatgagggggagcccgttcaatatgtgagcgattaccgtccgctgactatcgaacatacagacatcaggcaagccggctgctctgcggaagagctgtcaaaatggggacgtgacgaggcaagcaagcctctggcattatatgatcaggatttattccgtttttccgtgtataccatcagcgaaaatgaggtctggttttacgttaatgtgcatcacattatttcagacgggatttccatgacgattctgggcaatgcgattactgatatttatttggagctttcgggcggagcaagtatggaacagacggagattccttcctttatcgagcatgtgctgactgagcaggaatatgtgcagtcgaagcggtttaaaaaggatcgggatttttggaacgggcagttcgagaccgtgccggagcttgtgtccctgaaacggagccaggcagatgcgggtcttgatgcgaaacggttttctcaagaaattcctcacgacttatatggccgcattcattcattctgcgaggagcataaagtcagcgtactatctctgttccaatcagctttgatcacttatctctacaaagtgaccggccgggatgacgttgttacgggtacgtttatgggaaaccggacaaatgcgaaagaaaagcagatgctcgggatgttcgtatctacggttcctgtgcggacaagcgttgacggaggacagtcgttcttggaattcgttaaaggccggatgaaggatctgatgaaaattctccgccaccaaaagtatccgtataacctgcttgtcaatgatttgcgcgcttcgaaaagttcgctgagcagattgtttacggtggctctggagtaccaggtgatgcagtggcagaaaaaagagaatctgtccttcctgacagaccctattttcagcggaagcggtacaaatgatatttcgattcatgtgaaggaacgatgggacactgggaaattgacgattgattttgactatcgcagcgacatattcaagggagaggagattgtatctgtttctgaacgtttgatcacgctgattgaagatgcgatttcatctcctgatcgcataattgatgagcttactcttctttctgaatccgagaaagagcggctgctgacacgggcctccggcaatccggtgaattaccgcggggagatgacgataccggggctgtttgaagagaaagtgaagtcactgtctgacaaaccggcggtggtgtatgaaggccgaacattgtcctatcgcacattgcatgaacagtcaggccgaattgccggacgccttcttaaagccgggatatcagccgatactcctgtcgcggtgctgcttggccgttctgagcgtgtcattgcggcaatattgggaattttaaaagcgggcggcgcttatgtgccgatagatcctgattttccggcggatcggattcagtacattttggaggacagcggagcgaaggctgttctgacggaggccggaatacaggcgcctgtatcggatgccgaacggattgattttgacgaggctgttcagtttgaaacggctgcggacggtgtcagcacacaatcagaccggctggcttacatcatctacacgtcaggtacaaccgggcggccgaaaggcgtgatgattgagcaccggcaagttcatcatctggtgcaatcactgcagcaggagatttatcaatgcggtgagcagacattaagaatggcgcttttggctccgtttcattttgatgcgtccgtcaaacagatttttgcctcgcttcttttgggacagacgctttatatcgtgccgaaaacgactgtaacgaatggctcggcactgctcgactattatcgtcaaaaccggattgaagccactgacggaacccctgcgcatctgcagatgatggttgcggcgggagatgtcagcggaattgaattgcgccacatgctcattgggggagagggcctgtccgccgctgttgctgaacagctgatgacgctctttcatcaatcgggcagggcgccgcgtctgacgaatgtgtacgggccgacagaaacgtgcgtagatgcatccgtgcatcaggtgtcagccgataacgaaatgaatcaacaggcggcgtacgttccgatcggaaaaccgctcggcaacgcccgtttgtatatattggataagcaccagcggcttcagcccgacggcacggccggtgagctgtatatcgcgggtgacggtgtaggccgcggctatttaaatcttccggatttgaccgcagagaagtttttgcaagatccgtttaacggaagcggccgcatgtaccgcacgggtgatatggcgcgctggctgccggacgggacgatcgaatatatcggccgtgaagatgatcaggtgaaagtccgcggctaccgtattgagctgggagaaattgaaacggtgctcagaaaagctccgggcgcggcccaggccgttgtgctggcgcggccggatcagcagggcagcttagatgtttgcgcatatatcgttcaggaaaaaggaaccgagtttcaccctgccgagtacagggagtatgtgtccaagcaccttccagattacatggtgcccgcttactttacaaaaacggacgaaattccgctcacgccgagcggaaaggcagaccgcaaaaagctgtttgcgctcgatgtgcaggctgtcagctcatccgaatatgccgcgccgagaaatgaaacggaggaaacgctcaccgtcatctggcaggaagtcctcggaatggataaggcgggcatttatgatcatttcttcgagtctggcggtcattcattaaaggcaatgacgcttctgacgaaaattcataagcaaatgggcattgaaattccgctgcaatacttgtttgagcatccgacgattgcggcgcttgccgattatgcggaaaaccgaaacgaaggaccggcattcagtgcgattgagccggctgagaagcaggcgagctatccgctttcgctcgctcagcagcggacttatattgcgagccaatttgaagacgcgggagtcggatataacatgccggctgcggccatgattgagggcgctttagaccgtgaaaagcttgagcgtgcattttctgccttaatcagcaggcatgaagcgctcagaacatcgtttcaatcagaggacggcacgccgagacaggtgattcacgaacatgttccgtttcatattgaaatgatcgaagcgcgcggaagaacgaatgaacaggtcatgaaggactttgtgcgccgttttgatttatctgaggcgccgctgttcagaatcggcctgcaaacgctcggtcacaatcgccatatgctgctgtttgatatgcatcacctgatttctgacggggtgtctatttccatcatgctgaaggaactggctgacatctacggcggaaatcagctgcctgatttgcgcattcaatataaagattatgccgtatggcaggcggaacgggcgaaagaaggctacaagaaggagcgggcgtactggaaagaagtcttcagcggcgaactgccggtgcttcagctgctccctgattatccgcggccgcaggtgcaaagctttgaaggtgaccgcgtgtccgtcaagctgccgaaaatgctgcgggaacggctgcagaagcttgccgagaaaaacggagccaccctttacatggtgctgttatcggcatactatacgctgctttctaagtattcgggacaggaagacatcatcgtgggaacaccgtcagcgggaagaaatcactctgacaccgaggggcttatcgggatgtttgtcaacacgcttgcgctgcgaagctccgtgaagcaggatcagacatttgccggcttgttaggtcatgtgcgcaagcaggtgctggacgcgttttcccatcaggattatccgtttgagtggctgaccgaggagctgaacgtgccccgggacatgagcaggcatccgatatttgacacgatgttcagtctgcaaaatgcttcggacggaattccggagatcggcaacctgaggctgtctcttcatgaaaccaacttcaacatcgccaaattcgatctgacaatgcaggcccgggaaacagcggaaggcattgcgctcgatttggattattgcacgaagctgtttaagcgctcaactgcggatcgcatgcttgcgcactatgtccgtctgctggagagtgcggcagctcagccggatgcgaaaatcagcgaatatgatctgctttctgaacgggaggctttgaaccaattacagcagttcaatccggagcgcacggcatacccgaaagagcaaacgatcgtgcagatctttgaagaacaggcccgaaagaaccctgaccggacggctcttcagttcgaaggggaaactctgtcgtatcagcagctgaatgaacgtgccaacaggcttgcgcggcatattctttcggtcggaggcggcgggaaaaccgcggctgttttatgtgaacggtcaatggacatgattgtttccattatggctgtgttaaaagcggggtccgcctatgtgccgattgatcctgagcatccggttcagcggattcagcatttcttccgcgacagcggggcgaatgtgctcctgactcagcaaagcctcaagccgcttgcggaaaaggccggttttcaaggcgtcattgtgcttgctgatgatgaggcgagctatgaaaaggactctcgcaatccagcattgccgtttgactccagcacaattgccaatcttacttatacatcaggcacgacgggaacgccgaaagggaacatcgtcacacatgccaacattttgcggacggtaaaaaacacgaactatttgaccgtttctgaagaggacacagtgctcggtctgtcaaactacgtctttgacgcttttatgtttgatatgttcggttcgctgttaaacggtgcaaagcttgtgatcgtcccgaaagatacggtgctggacatgtcgcgcctgtcccgtgtgatcaaacgggagaacgtcagcattctgatgattacaacggctctgttccacctgcttgttgatatggagccgtcctgtctgacgacgcttcggaaaatcatgttcgggggcgaaagagcgtctgtagaacatgtcaaaaaggcgctggcggcagtcgggaaaggaagactgcttcatatgtacggtccgtcggaaagcacggtgtttgcgacataccatccggtggatgtcgttgaagaggatacgctctccgttccgatcggtaaaccggtcagcaatacggaagtctttattatgaactcagccggacgcattcagccggcgggtatcgcgggagagctgtgcgtcagcggggaaggtctcgtagaaggctactacaaccgtcctgaactgacggaagaaaaatttgtaaagcatccgtttaaggaaggtgaacggatgtataaaacgggcgacttggccagatggcttccgaatggcgatatcgagtttatcggacgtatcgaccatcaggtgaaaatccgcggtcagcggattgagcttggcgagattgagcatcagcttcaaagccatgaccagattcaggaatgcattgtgctcgctgtggatcaaggcgcgggtgacaaacttctttgcgcgtattttgtcggcctcagggaaatctcttcccgggagctgagggagcatacggcgaaggatcttccggcttatatgattccgtccgtctttattcaattggatgaactgcctcttacagggaacggaaaaatcgacagacgggcgctgccgatgccggatgtgaccgcagcgaatgccgtgtcatatacggcgccgcgcaatgaaacagaacaaaaactggcggatatttgggctgaggtgctgcaaatggaacgggtcggcgtccatgatcagttctttgagatcggaggccactcgttagcggggatgaaactgctggcccttatccagaagacattcggcgtgcagcttaccttaaaggatctgttcacttctccgacggctgcggggctggcgcagctgattgaaggggctgaacggaaggcggctgagagcatcgcaccggcggccgagcgggaaacgtatccggtttcttcaccgcagaagcggatgttcgtgcttcagcagctggaaggcgctgaaacaagctataacatgccgtctgtgctccgcttaaaaggaaagcttgatgcagaaaagctgaaatccgttatgaaacagctgacagaacgccatgaagccttcagaacgacatttgacataaaggatggagaaacggttcagcgtatatgggcggaagctgatatcgacatggaatattatgaagcctctgaagaagatgctgaacagattattcagagctttatccggccgttccgtctggatcagcttcctctcgtcagaacgggactggtcaagctggctgaacatgaccacctgctgctgtttgatatgcaccatatcatttcggacggcgcttcagtcggcgtgctgatagatgaactgtcccgcttgtatggcggcgaaacgcttgagccgctgcggattcattataaagactatgcggtatggcagcagaaatttattcaatcagagcagtaccgcaagcaggaggagcattggcttcgggagcttgacggcgagcttccggtattgacgctgccggctgattacagccgtccggccgtgcaaacctttgaaggagacaagctggtcttttctctgactgaggaacagacgtcggctcttcgcagtcttgcgaaacaaacggattctaccatgtacatggtgctgctggcgtcatacagcgcctttctctcaaaactgagcggacagcatgacatcattgtcggctcgccggttgcgggacgatcacatgcggatctcgcaaacgtcatcggtgtttttgtgaatacactcgcgcttcgtacgtatccggaagcggacaaaacgttcacggactatcttaaagaagtaaaacaaaccgctttacatgcatttgacgcgcaggattatccgcttgaagaccttctgcaaaaggttgaggtgcagcgtgatacgagccgaaatccgctgtttgatgcggtattctcaatgcaaaatgcaaatgctgaagatctggtcatggaaggaatcgagctgaagcaccatccgtttgacagaaaaacagccaagtttgacctgacaatgacggctgaggacacaggcgaaggcttaacgtttgtgcttgaatataacaccgcgctgtttaaaccggaaacggcagagacgtggaagcattactggcttcagctgttaaaagccgcaacggaaaatccggctgcgaagctttctgagctttcattggtgaatgaaacagaaaaacaagccctccttggtgcatggaaaggaaaaacaattcctgtgccgcgggacaaaacgg

SEQ ID NO: 117 - DNA, 100296 bp, Bacillus velezensis FL50S
gaaagacggctttgatccggacctggtggaaaaaaccctgcaagcattgattgaacaccatgatgcgctccgcatggtttaccgtgaagaaagggaaggcatcattcagacatacctccctgtcacagaatgcaaggcaagctttgaaatcgttgatctgtacggaacggacgaggatatgctgaaaagccagattcagcggctggccgatcatcttcagggcagtcttgatctggagaacggcccgctgttaaaagcggagcaataccggacagaacaaggcgatcatctgttaatcgcggttcaccatctcgtcgtggacggggtttcatggagaattctgcttgaggatttcgcttcaggttataaacaggcgcagcagcaaaacagcatcgtcctcccgcaaaaaacccactcctttaaagattgggcggaggcgctgaacacgtttgcgcaatcagaagagctgaaaaagcaggcggattattgggcgcaggcagatgcggaagaactgcggccgctgccgaaagaccatgatccggacaaacggctcgtcaaacatacggcggccgtgaaatgtgaattaactgaggaagaaacagcacagctgctgacagatgttcatcatccgtacggaacggaaatcaacgacattctgctcagcgcgctcggcttaacgatcggtgaatggacggaaaacggcaaagtcggcatcaacttagaaggacacggccgggaagaaatcataccgaatgtcaatatttcacggacggtcggctggtttacggcccaatatccgttgattctgcagatcagcaaggaagacggcgtctcttccgtcattaaaacggtaaaagagacagtgcggcgcgttccagataaaggtgtaggatacgggattctccggtatctgtcatccgatgaaacagaaaaaggcgccgcgcctgaaatcagttttaactacttggggcagtttgacaatgaagtgaaaacggaatggtttgagccgtctccatatgatatgggacgtcaagtcagcgaagagtcagaggcgttatacgcactgagcttcagcgggatggttacaggcggccgcttcgtcatttcctgctcatacaatcaggaagaatatgaaagaagcaccgtcgaaacacagatgcagcggtttaaagacaatcttttaatgatcatccgccattgcacggccaaagaggagaaagaatttacgccgagcgatttcagcgcgcaggatcttgagatggatgaaatgggagacatctttgacatgcttgaggagaatttaacgtgacaaaaacagttaacagaaggggggagcggagcagatgagccagttcaaaaaagatcaagttcaggacatgtattatttgtcgccgatgcaggagggaatgctgtttcatactctcctgaatcccggccaaagcttttacatcgaacaaatgacaatgagagtaaaaggcagcttgaatatcaaatgccttgaagaaagcatgaatgtgatcatggaccggtacgatgtatttcgtaccgtgttcattcacgaaaaagtaaaaaggccggtccaagtcgtattgaaaaaacggcagtttcagatagaagaaatcgatctgacacacttaacgggcagcgagcaagcatccaaaattaatgaatacaaagaacaggataagatcaagggctttgatttgacgcgggatattccgatgcgggcagccatctttaaaaaatcggaagaaagctttgaatgggtgtggagctaccaccacatcattttggacggctggtgcttcggcatcgtcgtgcaggatctgtttaaggtatacaatgccctgcgagaacaaaagccgtacagcctgccgccggtcaaaccgtataaagactatatcaagtggcttgaaaagcaggataaacaagcatcactgcattactggcgcgggtacttagaagattttgaaggacaaacgacatttgcggagcaaagaaagaaacaagagaacggctatgagccgaaagagctgctcttctcactgccggaggcggaaacaaaagcatttaccgagcttgcaaaatcgcagcataccactttgagtacggcgctgcaggcggtttggagtgtattaatcagccgctaccagcagtccggcgatttgatcttcggcacagtcgtttccgggcgtcccgcagaaatcaaaggcgttgaacatatggtcgggctgtttatcaatgctgttccgaggcgggtgaagctgtctgaggataccacatttaaaggcttgctcaagcagctgcaggagcaatcgctgcagtctgagcctcatcaatatgtgccgctctatgacatccaaagccaggccgatcagccaaagctgattgatcatattattgtgtttgaaaattatccgcttcaggatgcaaaaaatgaagagaacagtgaaaacggctttgatatggaggacgtccatgtttttgagaaatcgaattatgatctcaacctgatggcttctccaggtgatgagatgctgattaagcttgcctataacgggaatgtgtttgatgaggcgtttatcctgcgcttaaaatctcagcttctcacagcgattcagcagctcatccagaagccggatcaccctgtcaatacgatcagacttgttgatgaaaaggaaagagagcttctgcttaccggcttaaacccgccggctgagactcatcaggcgaagcctctgacggattggttcaaggaagcggtgaatgtaaatcctgatgcaccggcgcttacgtattccggccagactctttcctatcgcgaattagatgaggaagcgaaccgtcttgcgcgccgtttgcaaaaacaaggtgcgggtaaagacaccgttgtcgcgttgtacacgaagcgctcgcttgaactggtgatcggcattctcggcgtattaaaagcgggagcggcttatctgccggttgatccgaagctgccggaggaccgaatctcgtatatgctgactgacagtgcggctgcctgtctgctgacacatcaggagatgaaagaaaaagcggctcagctgccgtatacaggaacaacactcatcatcgatgatcaagcacggtttgaggaacaggcaagcgatcctgcagccgcaattgatcccgatgatccggcgtatattatgtatacgtccggcacaaccggaaagccgaagggcaatatcaccactcatgccaatatacaaggattggtcaagcatgtagactacatggcattttctgaacaagatacgttcttatctgtttcgaattacgcctttgacgcatttacttttgatttctacgcatcaatactgaatgcggcacggctcattatcgcagatgaacatacactgcttgatacagaacggctcactgatctgatccggcaggagaatgtcaatgtcatgtttgcgacaaccgcactttttaatcttctcaccgatgcgggagaggagtggctgaaggggctccgctgtgtgttattcgggggtgagcgcgcgtctgtgcctcacgtcagaaaggcgcttgagatcatggggcctggcaagctgattaattgctacgggccgactgagggaacggtgtttgcgacagctcacgtcgtgcatgatataccggattccatttcctcattgccgatcggaaagccgatcagcaatgcaagtatttatattcttaacgggcaaaaccagcttcagccgttcggagctgtcggtgaactgtgcatcagcggaatgggtgtatcaaaagggtatctgaaccgtcacgacctgacgaagcaaacatttatcccaaatccgttcaagccgggagaaacgctttaccgcacaggggatttagcacgctggctgccggatggaacgattgaatacgccgggcgtattgacgaccaggtcaaaatacgcggtcaccggattgaacttgaagaaatcgaaaagcagctgcaggaatacccgggtgtgaaagatgcggtcgttgttgcagaccgccatgagtccggagatgcatcaatcaacgcctatctcgtgaaccggacgccgctttcagctgaagacgtaaagaggcacttgaaaaaacagcttcctgcttacatggtgccgcaaacctttactttcttagaagagcttcctttaacgacaaacgggaaggtcaataaacggcagctgccgaaaccggatcaggctcaggcggcgaaagaatggatcgggcctcgaaacgcgacggaagaaacgattgcacacatctggtccgagattctcggcagacagcagatcgggattcatgatgatttcttcgcgctcggaggccattccttaaaagcgatgacggcagcgtcgcgcattaaaaaagagctcggtacggacatcccggtgcagctgttattcgaagcgacgacaatcgcagacattgccggttatctgcttcacggtgaagaaaaaggaatgaaagatctcaccatcatgaataaaaatcagtctgacacactgtttgcgttcccgccggttctcggttacgggctgatgtaccagccgctggcaaaacagctgtccggctatagaatctgtgcgtttgattttatcgaggaagacaaccgcatcgaacgctacacagagctgatcaatcagctccagccggaaggaccggtcaagctgttcggatactcggcaggctgcacgctcgcctttgaaacggccaaacggcttgaagccgaaggacgtaaagtggagcggctgatcatggttgattcctataaaaaacaaggcgtcagcgacttggaaggccgcaccgtagaaagcgatgtccaggcgctgatgaaggtaaaccgggataacgaagcgctgaatgacgaagccgtcaaagaaggtctcgccaaaaaaacaaacgcgttttattcttatttcgtgcataccgtcagcaccggcacggtcaatgcggatatagatctattaacgtcagaaccggactttgcgatgccgccgtggctcgcttcgtgggaggaagccacgacaggtgaataccgtgtgaaaaaaggctgcggcagtcacgcagaaatgctacagggagaatgtctcgaaaggaatgcggcatatttgctcgaattcctaaggaaggaacatccgaagctgacagcttcacgatagaaaaggaggaagcccgccaatggtccagctctttaaatcgttcgataccacggaaaaaacgcagcttatctgttttccgttcgcaggaggctattccgcatcattccgcccgctccacacctatcttcaaggtgagtgtgagatgcttgccgcggaaccgccgggacacggaacaaatcaaatgtccgccgttgaggattttgaacagcttgtcagtttatacaagcaggagttgaatctccatcctgaccgcccgtttgtcctgttcggccacagtatgggaggcatggtcgctttcaggctggcgcaaaagcttgagcgggaggggatttacccgcaggccgtgatcatctcagccattcagccgccgcatgttgaaaggaaaaaagtgtctcatcttgatgatgaaaaatttctcgcccatattatcgagctgggcggaatgccgcaggagttagtggagaataaggaggtcatgtcatttttcctgccttctttcaggtccgactaccgcgcgcttgaaagcttccgtccgtctgattctcacatgattcaatcacccgtccatatttttaacgggcggaaagataaaaaatgtatcaaagatgcggacggatggaaaaaatgggccgacaatcccgtatttcatgagttttcggacggccacatgttcatattaagtgaaactgaaaaagtggcggaacgaatatatgagattattaacaggagcactgcaggccaattgttataggatatgacagacagcattcgctgtctgttttttgtaacaaaatctgcccgtgagttttctcatttatcaaaaattttatgttatgatttgatggaatataattttgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcgggattgccacctcacaaggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttaacacacgggctgagcattgccgccgacttgttcgtcaatgaaggggatgcgctgcttctgccggataaatattggggaaattacaatttcattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctatacgccgggggaagaggaagcgtcagaaatcgtcagtgtgatcctggaggcagcggaggccggcaaagagattgtcgtgctcgtagacgatgcgtattacaatctgttttacgatgaaacggccattcaggaatccatcttcagcaaactcgcccaagtgcacgaccgggtgctttgcgtaaaaatagacggcgcgacgaaggaaaattacgcgtggggcttccgcgtcggttttattacgtacagcacaaaaagcgaaaaagcgctgcgcgtgctcgaggaaaaaacaaaagggattatcaggggaacgatttcaagcgccccgcatccgtcccaaacgtttatgctgcgggcgatgcagtcaccggaatacgagaaagaaaaatcgctgaaatataatatcatgaaaaaacgggctgacaaagtgaaagccgttcttgcagaaaacaagcactatgaagacgtatggacgccttatccgtttaactcgggttatttcatgtgtgtccggctgaaagacataaacgccggcgaattaagagtgtcgttgcttgaaaagagaggaatcgggacgatatccattaatgaaaccgatttgcgaatcgcattttcatgtgttgaagaagaatacatcgcggatctgttcgaagaaatttatcaagaagcaaagcagctgcagaaacaggcggaaatatcaggctgacaaaaaaaggagggggataccctcctttttctatgcttacatcagctcttcatacgttttcatctcaatcccgtcacaaaaatcgggatgcgccgcacaaacggccagcttatattcctcgtccgcatcatatgtgcggatgaaacaaggttcatgtccgtccgggagctcaatggacacatggccgtcgtctttgaggcggacgctgaatgaatcaagcggaagggaaagcccttttccggcctgcttgataaagctttctttcatcgaccacaggaggtaaaaataatcggtctgctgatcggggtgtttcgcttgcagatcactgtattccgtcggcgaaaaaaaacgtttggcgatatcaatcgtgccgggcttcattttttcaatatcaatgccgatcggttttgaatcaacggcacacacgatccagcgcccggagtgggaaatgttaaagtgcatgtccggaagcgcggggatgtacggctttccgtattcctggacgctgaatgaaatcgcggccggatcaagtccgtaagccttcgccgcagcggtgcggatcagcatgtcgccgatcaaggtgcggtgagcatcctccttatggtaaaagcgccggcatttttcccgcttttcggcggacacggccgccatcatccgatcctcttcccctgcagaaagcgggcggtccatatatactccgtaaatcttcatgtccagatcctccgtctgaaaatattgtcaaaaccatcctaccatatcagacgaaagctgtccgaaaataaaaaaacaaaaccgtttcggctttgtttttaatgaacggacgttgcccgcccggagatcgcgtatgttaacagtttagaggactgcggcaaagaaaaacgcagaatcagccccgtcaaaacagccgtaataatggttccggcgccgatcggtccgcccatcacccaggctgcggcaagaatcgtcagctcaatgccgttccgcacccattgcacgttccagcccgttttttcagatatcagcatcatcagagagtcccgggggcccgcgccgagccctgctgatacgtaaataccgacgccgcagccgatcagcagcaatccgatagaaaaaaacacggccgctaaggaaaaagcgtgcgcctcaggaagcagaaacgagaagaaatcaataaacattcccatcagcaccatatttaagatagcgccgattttcgggagcgtcctcgtgaacaggcaggttaaagccacgatgaccgcgccgaccaagatggaccattggccgacagatagcccgaaatgctgaaaaagcccataatgaaaggcatcccaagggctgatgccgagagcttttcctttaatggttaacgataccccgaaagacaaaatcaacagaccggcaaaataaaacgtccagcgcatcaagaattcccgcttcaaagaggtcccttctttcataacattcattaattgtcattgtagcataaccgcccaaaaaaagaagaagcgaaatcagtgtttcgcttcttctccggctcctacaaaggattcagtatacgatttaaaaaccgctgcgtgcgttcttctttcggcgcggaaaaaatctgggccggcggtccttgttccacaatgacgccgccgtcaatgaagatgacttcatcggccacttcctgcgcgaatttgatttcatgggtgacgacgaccatcgtccagccttcgttcgccagatccttaatcactttgagcacctcgccgaccagctccggatcaagtgctgacgtcggttcgtcaaacagcatcagctcgggctgaatcgcaagcgcgcgggcgatgccgacccgctgctgctgaccgccggaaagctggaacggatataaattcattttgtctttcagtccgactttttccagaagctctatcgcttcttttctgacttgctccttgtcgcgcttttgcacttgaacgggtccttccatgacgttttcaagcgccgtgcggtgaggaaacagatgatacgcctgaaagaccatgcctgatttgcggcggaggcggagaatatcagcctgcttcacttttttggagaaatctattgaaaaatcggagaatgccagctcgccgcgattggggatctcaagcgcgttcagacagcgcagaagcgtcgtttttcctgaaccggacggtcccagaatggcgatgactttccctttttctatctccatatctatcttttttaaaatttcattctgtccgaatgatttatttaatcctttgacggaaagcatatcgaaacctccttatttggccacataacggtcgagacgccgttcgatcacatgctgtacgattgacagcaagaagcagatgatccaatagataaaggcggcttcaatatagatgaccaagatttgatcaaggttttgcgcgccgatttcctgcgcttttctgaacagctccgcgacgagaatctgtgacgcgagagatgtatccttgatcaggctgataaatgtatttgataatggcggaatggacacgcgaaacgcctgcggcaggatcacgcggaacaatgttttgcgataggtcatgccgatcgtataaccggcttcccattgccctttcggcacggatgaaatagatgcccggatgatttcagaagcataggcgcccacgtttaatgaaaacgcgatgactgcgcttgggaaagggtccagcgtaatattaaatgtcgggaacagataaaaaatgatgaacaattgaacgagaagaggagtgccgcgcaccgctgatacgtatacgctgaacacccatctcaatggtttcatatttgacattctggcgagcgccgtaatcagcgcgatgatcattccgaaaataaaggaaagaatggtaaggggaatcgagtaatagattcccccggaaagaatcggccagaatgactgctgcaccaaatcccacggaatggctgttgcaatcacgggttccggcatgttacttagaaacatcttcgccgaaccattttttcgctattttagaaagagtcccgtcctctttcatttcttttaacgctttgttgacgtgagtcacaagttcgccgcttccttttcggaatgcgaaatatgtctgctgcggctggcctgcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgctgtttttcctttgacatcagcctctttcgcaatcgtgctgtcttttttcgtcacgacgactgcatttgacgttgtgtatttatcagaaaaatcatattggttctcacggcctgttttgccgacttggttggcgacgacgtcaaaccgtttcgcgtttaaaccggcaaacatgctgtcccattgtgtttctttaaagtcagctttcagaccgaggcgtttcgcgacttcttgaatcacttcaacatcatatccggtcagtttgtcagtctttttatcatggaaggtaaacggttcgtacgttccttctgtaccgacggtcagtacgccttttttcttgacagaagcccaaagatcgccgtcttttgacttagatccgctgtcctgtgagtttccgcaggctgcaagcattgcgatgctgaccatcatgaacaaagcgaataatgcttttttcatcttctttattccccacttttctgagtagttttattgagaaaaaatagctcccaattgtaaaggataacttttttttagtatgagtcaagtaattggttttcataagcgggaattcatcgtgttccggatcaaaataattccaaaaactgtctgacaggcttcggcaggtagctgtcttttctccagatgacggccggtgtcatgacaaacgggttgtcttcgatgataaccgttttgacatgcgagcgcatatggacgggaatcatcgtcaaaggcagaattgtggcgccgaatcctgatgatacaaggctcaagagcgtcgcggagtcatggcattcacaaacaacctggaggtcgagaccgtactgttcacaaacttggaggacttggtcatacacacctcttccattgacggtgcgcaaaaggatcagaggcaaagaggcgatgtcattcagtttaatcgtttctccgcacagtcgttttgaatgctcggacagcaccaatacacacggaatgtcttcaagctccttcgattcaatgccatcgtttttaatcaaggtggtggtgacggcggcgtcaatctgccgggtttccagaagctcgagcagtgagacgggttcatcttcccaaatgttaaaggtgagatgcggaaaccgctctttcatctgtgacactttctcaagcatgagcgctgcgcagtaaatggttgacccgacggcaagtgtcccggccacctcctccttcagctcttgtacctcgattatagcgtcctcaaacttatgaagaatctctttcgctcttttcaaaaagacgtttccttcatatgtgagggtcatttgtttctttttattgcggtcaaacagaatgacgcccaattcttcttcgagctgtttcaactgtcggctcaaaggcggctgtgccatatggagctttttggcggccgtcgtgattttctgctcttgggcaatggtgatgaaataacgcaattgccgaatatccatgagaacgctctctcctttcttttatacctttaaggtatgatacatagatttaacgaatatttttcatatggatatatcaggagtatgatggatttgacaccacatttcaagcgtaaaggaggggtcaatatgaagctcgtcatcggaatgaccggggcaacgggagccatattcgggatcaggcttttagaatatttaaaagccgcggagatcgaaacccatcttgtcgtgtctccttgggcaaatgtcaccattacacatgaaaccgattatacgttaaaagatgtcgagaaactcgcatcctatacgtattctcacaaagaccaggcagcggcgatttcaagcggctcgtttgaaacggacgggatgatcatcgctccgtgcagcatgaaatcactggcaagcatccgcaccggaatggctgacaatctgctgacaagggcggctgacgtcatcctgaaggagcggaaaaaacttgtgctgctgacaagagaaacgccgctcagccaaatccatttagaaaatatgctagcgcttacaaaaatgggttccgtcattcttccgccgatgccggcattctataacaagccggctgacatggatgaattgatagaccatattgtgttccggacgctcgatcagttcggcatccgtctgccggaagcgaaacggtggtacggaattgaaaaacaaaaaggaggaatctgataatggcctatcaggattttagggaatttctcgccgctcttgaaaaagaagggcagctcttaaccgtcaacgaagaggtaaaaccggagccggacctgggcgccgccgcgcgtgcagccagcaatctcggggataaaacccctgcgcttttgtttaacaatatttacggacatcacgatgcgcaggtggctctgaatgtcatcggctcgtggccgaatcacgcgatgatgctcggcatgccgaaagatacgactgttaaagaacaattctttgagtttgccaaacggtacgatgcatttccggtgccggtcaaacgggaagaaaccgcgccgtttcatgaaaatgaaataacggaagatatcaatctttttgacatccttccgctattcagaatcaaccagggggacggcggctactatttggataaagcgtgcgtcatttcccgcgatcttgaagatccggacaatttcggcaagcagaatgtcggcatttacagaatgcaggtaaaggggaaagaccgcctcggcattcagcccgtgcctcagcatgatattgcgattcatcttcgccaagctgaagaacgcggcgtgaatcttcccgttacgatcgcgctcggctgtgagccggtgattacgacggctgcatcaactccgctgttatacgatcaatccgagtatgaaatggccggcgcgattcaaggggagccctacagaatcgttaaatctaaattgtctgatttagacatcccttggggtgctgaagtcgttctggaaggagagatccttgcgggagaacgggaatacgaaggacctttcggtgagttcacgggccattattcaggcggccgcagcatgccggtgatcaaaatcaaacgggtatatcatagaaacaatccgatttttgaacatttatacttaggcatgccgtggacggagtgcgattatatgatcggcattaatacgtgcgtgccgctttaccagcagctgaaggaagcctatccgaacgaaatcgtcgccgtgaatgcgatgtatacgcacgggctgatcgccattatctccacgaaaacgcgctacggcggatttgccaaggccgtcggcatgcgcgccctgacgacgccgcacggactcggctactgcaaaatggtcattgtcgtggatgaggatgtcgatccgtttaacctgccgcaagtcatgtgggcgctctcaacgaaaatgcatccgaaacacgatgcagtcatcattcctgatctgtccgtccttccgcttgacccggggtctgatccggcagggatgacacacaaaatgattcttgacgccacgacgcctgtcgcgccggaaacaagaggccattattcgcagccgcttgattccccgctgacaacgaaagagtgggaacaaaaactgatggacttaatgaatcaataagaaaggatgagtttactatgaaaacatgcccgcgatgtgaatcgcaaaaaggagaaaccgtcagccaatcgccggtcaaaggcgcttgggaaatataccaatgccaaacctgctttttcacatggagatcctgtgaaccggaaagtatcacgaatccggcggcattcaacccggcatttaaaatcgatccgaaagaaacagagacggccacacatgttcccgctgtcccggaaagaaaagcgtaatgctgacggagcacttgccggaggcgctttacgcgcttttagacggaacggaacttgaaaaaaagcagcacgacgcatttgtgctccaatccgtgacaaaagaaggccgtccgcacgcggccatgatcagcgccggtgaaatcgcggccgtgagcagaacaaatctccggctcgccttatggaaaaacacgacgaccgtaaaaagcctgctgcattcgggacaagctcttttcatcgcctggcacggaggagccgcatattacgtcacattggaatgtaaggcgcttccgccgttgaaagaggcgaaacacgagcgggaacggttcagctgccgcgtgatcaccgtcaaggaagatcgggcgaaatacgcggatctgacatcaggaccggccatccagctccacgaaccggaagatgtcctgaagagatggagagaaacacttgaggagttaaaacgatagacgcacaaaaaaagcctgcggacgattccgcaggcttctcttttattgtacgcctttcatcgcccgtttaatgacgggagacagaagaattaaaataataccgagaatgatcgaaacaagaccgattgagccgaagtaggccgcttcagaaatcttatcaaacaaaccgactacttttgcgttcagggcttgaccgcaggcgtttgttaaaaaccacatactcatcgtctgcgctgagaaagctgcaggcgcaagtttcgttgtgacggataaaccgaccggtgaaaggcaaagctcaccaagcacaaccaaaaggaagctgagcacaagccaaagcgggctcacaagctcgccgcttccgcccataaccggaagcaccatgactaaaaatgataatccggcaaggataatgccgatcgcgaatttaatcggtgttgaaggctggcgtttgccgagcttcatccagatccacgcgaacaccggcgcgaaaataacgatgaataatgggttcagagactggaaccatgaagactcaagatgcatgcccgcaaaggaaagtctcgtgcgctgatccgcatataaagctagaatcgtcgcgccctgctcctgaatcgcccagaacattgccgctgcaataaacagcggaacataagccgcaagccgtgatttttccgttttcgtcgcttttttgcttgtgaacatcacgataaagtaaataaccggaatgacaatgccgaggatactgacggtgtcaatcacacgctggatcgtcagccagccggtttgaatcagaacaataataacggctgctgcgatgaccaccccgattcccgtgccgatcactgatgatttagaaatcggattcggtacattggagcctgctttgccgaggtatttctttctcgtaagagcgaaaacaatcagtccgaggaacataccggccgcggcgcatccgaagcctaagtggtagttgtacttctgtccgagtgttccgacaattagcggcgcaagcaatccgccgaggttgatccccatgtaaaagatgctgaaacctgagtcgcggcgctcgtcttccttcgtatataaatctccgacaacgctggatacgtttggtttaagcaggccggttccgataatgatcagagccatgctggtaaaaaacgccgccgtgctgccggggaaggcaagagcgatgtgcccgaacataattaaaattccgccgtaaaatacggtgtttgccgtgccgaatacccggtcggccagccatccgccgatgacgctcgacatatatacgagagatccgtatatggacatgatggcaactgcggtcgttttatcaaagccgagaccgccatgagcgacttccgtgtataaatagtaaagcaatatggctctcataccatagtaggagaaacgctcccaaaattcggtaaaaaacagtgtgaacaagccgcggggatgaccgaaaaagcctcgttgcggcacagtttctgttatagattccttatcaatagatgccacctgagccaaccctttcttaaaaaagtgtattacaaaaatcatattcttatataatacttgtgtcaatataatttatactgaattcaaaaaattccagaatgaaaagatattaaaacggtgaatatagacgaattttcctgattccaatgacttattttgttatattatctgactaaactatctttataaacttttttaataaaatttaaagtatgtacaggcggagcgggatatggcggaataagatgacaataagagaggaaggaggagattatcacttgccgaatcgtatattggatattacggattgcggtgtggcggcagacggaaaaaccgatgtgacgggcgccatcaaccaatgcttggccagagccgtcagcgaaggctgtcatacggtgttttttccgcccggaacgtataaaatcaacggcacgcttggcggggacaaaagccagccgtttcggaacgccgggattaacgtgccgagccatctcaccatcgttttagatccggaatgcacgattaaagtggcgccgaacagctcctggggctactcggctttctatataggcaggcgtgaaaatgtcaccatcaccggcggccggatcatcggggaacgggatgaacacacgtataccaatgtccctttgcggtcgacccatgaatgggggtttggaatctgtattgaaggcagcagcaatgtgctgatcgaaaatgtgaagatttcagattttacgggagacggtataattgtcagcccgctcgggttaaaaacaaacagtgattacgaaacttcagaacaggtgaccatccgccgctgtgagatcaggcagtcaaggcggaacaacatttcaatcaccggctgcaataccgttacggtggaagaatgcgtgattgaagacgccgggcaagggaacggaacggctccgaaattcggaatcgatattgaatcgtacggagaaggcgatattgattatgaagaagctcttcatattacggtccgcaacaacttcttttccggaaacgccgcaagctcagtcaccaattttaacggatataatgtgttaattgaaggaaatcattccgataacacaatcagctacgggtatggggcgcataccgtcattacggggaatgtcttctttcggtcagacggcggctcaaggaccgcagtcgccggacaaggtgtgtcacaaggacaggacagcagcagtgccgtcatttccaacaatctgattaccgggttttccaccggaatagatgtaaggggaaaaagcgtcctcgtcacccacaacaaaattaatcaatttgaaaatacgggcatttccgtctatcaggcagaagatgtgaccgttgacggcaatgtcattgaaaacggacgttccgaaacgagacgaagcacggggatgcgggcgacgctttcggagaacgtcgtctttacgaataacactctgaatcaggtgacagacggaatcagcatgtcggccggcagtatcattgtaaaacaaaatgtgctgaaatcgttcagccggggcatatggatcacaggcggaaatgccgttattgaaggaaatacgctccttccgaatgcgtatcagggcgccgcggagtcctatgccgtatctgtgacaaatgacgccggggctgtcatcaaaggcaatctctttaagaactataaaaactatcccgtattcagttcaacatcctcgggaacctctgtcatcagcaaccgctttgaatcatcaccgcttatcgttaccgtgtatctgaactcaggcacgcatgaagtcatagacaatacgctcacgatcaaccgaacagcgggcagcccgatcggcatctatctgaacggagcctccaattccctcgtttcgggcaataccatcaacaacctttccgccgcttctgcttccgccatccaaaccagctcctccgcaagtactaaaatcatcggcaaccgcattatcaaaggcgtcattgtgaagcacgcgacagatacggaaagcggaaatatcgtcatctgagaacatctgcgccggaaaaataaaaagaacacatgaactccgagagaaggaggaatgtgttcttttttgacacaatacagccttgcgcctgtcaggcatcttttttacctgatttatataaagcgatcatttctctgattaaaaagagggcgaataaaaacagcatcagccattctgagaaggtggtcaatttaaaagcggacaggttgttttgaaccgctccatagaaactgaaaccttgcagcatatccaccgttactgaaatgatcagacaggcagtcagcaaaaagaatgaaacccctaatattttcatgcgcatcactctccctttttatccttttcgattacgcagaacttatacagactttccgccgtgcataatcttttgccgtacaggaagaatatgaaaaaaacgaggaaaggttttttgcgatatgccgccattttttaagcagaggaaacaaaaaaaagccgatcaaaacgaccgtgacaatgaaggcagaaaagaagcggacagccagccggacaaagagcgggatgagccgatctccctcagcttaaagcaaaatatgaagaagctgtctgagaggttcggcaacagtgccgatgtcgtcatccgccggctgaaaatcggaaaagaagagcttccggccgcaatcgtgtatatcgccggtttggtagacgaacagcttgtcagccaatcccttctggaggatttaatcgatatcccgtccgttcagccggaacaagcggtctgcctgatatacgataaaacgcttgcgatcggcggggtgaaagaggaagaaaaatggaaaagcctttatgccgggctggtggcgggcagcacgctcatttttgtcgacggggctgacaaggcgctgatcgccagcacggaagggggagagcaccggtccattcaagagccgagcactcaggtctctttccgcggcccgcgccagggattcactgaatctctgcaaaccaatatttcaatgatccgcaggtatgtaaaaacgcctgatgtgtgggttgaaaaaatggagatcggacacgaaacgaatacggatgtcgcgctgatgtatattaacggaatttgcgataaaaagctgattaaggaagtccgcaagcggctgaagcacattgacatcgacagcattctggaatccggctacattgaacagctcattgaagacgcgccgttttctgtgttccccaccgtatatcatacggagcggccggacgtcgtggcggggaatctgctggaaggacgatttgcgattatcgtggacggaacgccgttcgttctcatcgcgccggccttatttattcaattttttcaatccgttgaggattattattcacgatttgatatcgccacaagcatcagggtgctgcgggttttgattttcttcatttcactggtggcgccggggatttatgtggcggcgacgacctttcaccaggaaatgattccgacgcagctgctgattgtcatcgcggctcagcgggagacggtgccgttcccggccgtgattgaagcgctgacgatggaagtggcttttgagattctcagggaggcgggtgtccggcttccgagagttgtcggctccgccgtttccatagtcggagcgcttgtcatcggccaggccgccgtacaggccggcatcgtctccccggccatggttatcgtcgtcgcgctgacggcgattgccagctttgcgaccccggcttttgacatggcgatatccgcgcggctgatccggtttctctttattctgtcagcggcggtcatgggattttacgggctgattctgggcattatcatgatgttcgtccatctgtgcggcctgcgttcattcggttttccgtatatgtccccgctcgctcctttgaccccgggcgggctgaaggattccatcctccgcgctccgttatgggcggatgaaaaaaggccggaactgctcgtgcaggaaaacaacaggcgccaaggggaacatcaaagaccgaaaccggagacatccagagggatggttaataaagatgtagaagagggcgacggtaatgaaaagacgtaaatggatacttatcctttgtacgatggtttcccttatgtttgtatccggatgctgggataaaagggagctgactgatttggctgtgatctccgccatcggtattgaccggaccgaaacgggaaaatacgtccttcacttgcaaattatcaatccgggaaacgtggccggcggtctgcagggcggcggagcgggagaccggcctccggtttccgtctattcggtgtccggagacaatatgacggaagctttgagaaaaggctcgatgaaagtgtccagaaggctctattttgcgcatacgaatctcgtggtgttcagtgaaaagctggcgaaagaggaagggctcagttttattctggacaatcttgaccgcgacaccgaattcaggacgaccgcaaccgcggtgatcgcgcataattgcaaggctgaagacattattaaagtgctgacgccgattgataaaatcccttccaataaagtgaacaagacgctcagcttcacgcaggaacaatacggcagagtcattaaaaccagccttcaggacgttctgattgatctcgcttctccggccgggtcgccgtttattccgggttatgaaatgcacggagacgataaagccggtcctacgatggaaaatacgcagacgactgaaccgaaagcagtgctgtcagcggacggactggcggtgttcaaaaaggatgggaggctggattactggattgaggatgacgacagtgtgggggctgtatggctgctcaataggatcaagcatacgttcatcaatgcggattggaagaatgtgaagcacgcaatcagtctgcaggtcacccgccagaatacaaaggtgacggccacttttccgaacggaaaaccgcatattcacgtgcatgctcaggtcgaggggctggtggacgctgtcagataccctttccatctgtctgatccgcaagtgctgatgacgatgcaaaaggcgctcagcgtgcagcttgacaaagatatcaccaaatcaattgaagatataaaagcccgtaagaatgacttcgtcggcttcggagacctgatctatcggaagcatccggacaaatggaaaaagttcaaagggaagtgggatgaagaatatttccccaatctccccgtagatgtcaaaacggaagtcattatcagaagaacgggcttgcggaataatcctctctcagacaagcttgagcatgattgatttgaggagaaaggaacgaagcgtatggaaaatgcgaaaatcggcacgcgtcagctgtttattatgatcattttgtttgaattgggcagttcgttattgatcccgccaggcacgatggccgggcgggatgcatggctgtccgtgcttctcgggtgcgttatcggtctcggacttttctacgtttatcaggcgctgtatcaattttttcctgagtcttctccgagagattacatgaacgaactgatcggcagacatctgagctgggcggtctcgcttctttatattctctatttttcttatatcgcggcccgcgtattgcgggattttggcgaaatgcttgtcaccttcgcctaccaggacacgccgcttttaattgtgaatgccatgctgatgatcgccgcgatatttgcggtcagaaagggtattgaagtgatagcgagagccggcgagctgctgtttggcattatgtattttctgacagccgtcgggctgatcctcattatcagctcaggcacgataaacctcagatttctccagcccgttttagcggagggtgcaggaacggtcatttattccgtgtttaaacagacgatgttcatcccgttcggtgaattaatcgtgtttgtcatgattttcccttatttaaaagatcggaaaaaggtgaagaaaaccggatttctggcgattatcatcagcgggctgtttttggcgatgtcagtggcgattaatatttgtgtgctggacgtcaacttaatgctccgctctcaatttccgctgctgagcaccatacagacgattaaagtagaagagtttttagaccggctggatgtctttttcatgctcgtgctcgtcatcggcggttttttcaaagtcagcctttttacatatgcggttgtcgtgggtgtgtccacgctgtttaaagaaaaaaatccgtctcagctggcctttccggtcggattgggggtgctgattctctccatcagcatcgcaagcaatttttcggaacacatgaatgaaggcttaaacattgtgccgatctatattcatcttccgtttcaagtgctgttccccgttttgctgcttatcattgccgttattaagaaaaaggtcaaagggaccgtctatacagtttcgaagaaataacccggacggtgcgccgggttatttttaaaatcatgatttttgtcttaatgcattgacaaacttgcgtgacaattgtacattttgatttattcttataaaattactaggaaatataggtttagtggtgttaatattttccgaaccgtatttcagaatagaaggagatccatcatgacaaagaaaaaagaaatcaaactcggtgtgtttctcgcgggcaccggccatcatgtcgcttcttggagacatcctcaggcaccggcggacgcgagcatgaatttggattatttcaaagaactggcgaaaacggctgagcgggggaaattggacatgctgtttttggcggacagtttatcaatagacggcaaatcacatccgaatgtgctgacgcgctttgagccgtttacgctgctgtcggcgctcgctcaggtcacatcccgcatcggtctgacggcgaccgcgtctaccacatacagcgaaccgttccatatcgcgagacaatttgcatcgcttgatcatctttccaacggccgagcgggctggaatgtcgtcacatcttcgattgaatcgaccgcgcttaatttcagcggcgaaaagcatcttgagcaccatctcagatatcagcgcgcggaagaattcgttgaagtcgtcaaaggattatgggattcgtgggaggaagacgcctttatccgtgacaaagagtcaggagcatttttcgataaagaaaaaatgcatgaattgaaccataaaggaacatatttctccgtgagagggccgttaaatgtcgcccgcacacctcaagggcgcccggtcattattcaggccggatcatcaggagacggaaaagcgctggccgccaaaacggcggaggtcattttcaccgcgcaaaatcatttggagtccgcgcaggaattctatcaatctattaaagaacaagcggcttctttcggccgtgatcctgaaaaaatcgcgatcatgccggggatctttcccgttatcgccgataccgaagaagaagcgcaggcaaaatatgaagagctccaagacctcatcattccgtctgtcggattgaacattctgcaaaactatctgggcggcgtcgacctttccgcctgcccgcttgacggcccgctgcctgaattggatgcggatgcgtcgaatgccgttaaaagccggttcaagctcgttcaggagatggccaaacgcgataacatgaccatccgcgagctgtacaaatatgtggcgggttcaagaggccatcatatctttgtcggaacgcctgaacagcttgccgataagatggaagaatgggtcggaaaacaagcttgtgacggcttcaacatcatgccgccgcttttgcctgaaggtctcactctttttgtagacaaagtgattccgattttacaagaacggggcgtgttcagaaaagagtatgaaggaaccacactcagagaacatttcggactggaaaaaccggcaaaccgatatgccgactaaaggagggctcatcatgtcaagacaataccggctcgcaacggaggcagacgctgatgagctgctttcactgacactgcgggcgtatgaaccgatccgcaagctcggcatcaactttgccgcagcaacggcggataaggagctcgttttgaataacatacaaaaaaacgcctgttacgttttggaggaagacggacggattctggcgacgatttctctgcggatgccgtgggggccgaatcccgggccgtacggtgtccctcatatttggtggttcgccgtcgatcctgaaaccggaaaaaaagggacgggctcagacatgctggagtggctggagaacacagtgctccgcgatacattaaaagcgcctttcgtgtcactgggcacagcggacaagcatccgtggctgatcggcatgtacgagcggaaaggctacgtccgcgcaggcgaaaaggatttaggaaaaggccacatcaccatctatttaaaaaaacaattgcaggattaacattttaataggaaaaggcgggatttcaatgaagaagaaaacatgggctttgctgctgtctgccgcgcttttggcggtcttaacagcatgcggaaacggaaaagaaagcgaaggcggcgataacgtgctgcatgtcggcgctacgggacaaagctatccgttcgcatataaagaaaacggcaagctgacaggctttgacgtggatgtaatggaagccgtagcgaaaaaaatcaacatgaaactggactggaagctgcttgagttcagcggactgatgggcgagctccagaccggcaaactcgacaccatttcaaaccaggtcgctgtcacggacgaacgcaagaaaacgtataacttcacagaaccgtattcgtatgcgggcactcaagtcgtcgtcaaaaacgataacaaagacatcaaatcagtcaatgatctgaaaggaaaaacagtggcggccgttctgggctcaaaccacgcgaaaaaccttgagagcaaggacccggataaaaaaatcaacataaaaacatatgaaacacaagaaggtacgctgaaagacgtggcttacggacgggttgacgcctatgtaaacagccgcagcgtcctgatcgcccagatcaaaaagaccggtctgcctctgaaattagcaggagacccgattgtctatgaaaaagtcgctttcccgtttgcgaaagatgcggctcacgataaaatccgcaaaaaagtaaacaaagccattgaagacctgcggaaagacggcacgctgaaaaagctgtctgaaaagtactttaacgaagatatcacaaaggaagcaaagcaataagaaacggcggtgaaaatcgagaatgaacagcattgattggggatttatgttttcagcttttcccgcgttaatcgaagccttgccgatcacattactaatggccgtcgcggccatggtatttgccgtgatcggcggccttatattagcgcttatcacaaaaaatcgtattcctgtgcttcaccagctgtcaaaggtgtatatttcatttttccggggcgtgccgacgctcgtgcagcttttcttaatttattacggcctgcctcagctctttcccgggatgagcaagatgacggcgttaactgcggcgattatcgggttaagcctgaaaaatgccgcctacctggctgaaatcttccgcgctgcgctcaactcagtcgatgaggggcagcttgaagcctgtctgtctgtcggaatgacaaaatcccaggcgtacagacggatcattttcccgcaagccgtcagaaacgcgcttcccgcgacgggaaatacgtttatcggcctgttaaaagaaacatcgctcgcttttacattaggtgtgatggagatgttcgcccaaggaaaaatgtacgcatcgggcaacctcaaatattttgagacgtatttagccgtcgcggtcatgtactggattcttacgattatttacagtgtgctgcaggatctgctcgaacgggcgatcagcaagccttatcgcacataggaggaggctcaggatgatacaagtcagacatattcgaaaagcatttaaagatcttaccgtacttgacgggatcgatcttgagatcaaaagcggcgaagtcacggccatcatcggcccgtcaggctcgggaaaatcaacgctcctccgctgtctgaatctgctggagcgcccggatgacggcatcattgaaatcggcgatgcaaagctgaatgcagcgtcctattcgcgcaaagacgtacacaagcttcgccagcagacggcgatggtgtttcagaattacaacctgttcaaaaacaaaaccgccctgcaaaatgtgacagaggcgctgatcaccgcgcaaaagaaaccgaaaaaagaagcggaacagatcggtatggacctgctgcggcaagtcggtttagaacacaaagcggacagctacccgattacgatgtcaggcgggcagcagcagcggatcgggattgcgagagccttggccgttgatcctcacgcgattttactggatgaaccgacttcggcccttgaccctgagcttgtagccggggtgctccaagtcatcaaatcaattgccgaaaaacagacaaccatgatcatcgtcacgcatgagatggcttttgcgcgtgaagtagccgacaaagttatttttatggcggacggacgcatcatcgaacagggaacgccggaggagctgtttgacaatccgcagaacgaacggacgaaaaaattcattaagcaagtgggagagcctgccgaacttgtctaagaagggaagaagaagaaatggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcggcagggcagatcatcggcggcctgcaatcgattgtcagcagaaacatcagctcgcttcacaatgccgtcgtcagcatcacaagagttcaggggggcagttcttggaatgtcattccggaccatgttgaaatggaaggaaccgtccggacgtttcaaaaagaagcgcgggacgctgttccgaaacatatgaagcgggttgccgaaggaatcgcggccggattcggggcagaggctgacttccgctggtttccttacctgccgtcagtgatgaacgatgcccgattcatacaggcggcggaacaaacggctgaaagcctcggacttcaaaccgttcgggcagaacagtcgcccggcggcgaagacttcgcattatatcaagaaaaaatccccggcttcttcgtctggatgggaacaaacggaacagaagaatggcaccatccagcctttacactcgacgaaaaagcgcttccgaaagcggctgagtttttcgcccggcttgccgtcaatgtattggagcagacggaatgaatacggaaaatctgacggccggacttgctcaggccgtcatgtcgtctgtgccggaaacatccaccgaagcgatgaaagaagcgcgcaaaggactgcttgattttacagcggctgcttttgcggggagacgggatacaggagttgaaaagctggtaaaactggccgaagaagaaggcgggatgccgatagcgccgcttatcggcagaaatcaaaaaaccacgccgtcccaatccgcgctcattaacggcttcatcgcacatgcgcttgattttgacgatgttcattctgatgtaagaggacatccgagcgcggtcatcctcccggctttgattgcagccgcatcagccgaccggatagacaagagccgttttctcggtgcttatgtgacgggaatcgaagtgatggcgcggctcggcgagtcagctggaagggatcattacgagaaaggctggcacaatacaggaacgttaggtgccattgcggccgcatgcgccgtcggattcgcagagaatctgaatcaaacccaattacagaaagcaatcgggtttgcggctgcccgttccggaggcatgagagtgcaattcgggacagaaatgaagccgctccacgccggcctggccgctcaagccggggtgttcgccgtaaagcttgcaaaggccggtttcggcggctcagctcatgcgctcgacggggagaaaggttttttcggactgtacggcgatcttgaacgggcagaaaccctgcttgtaaacgggtggggaaacccttggcggatcgtgagtccgggactttggtttaaggtttatccgttttgctcggcggcccatcatgcggcggacgccattctcaagctgaaggccgaacatggtctcactttcggccaaacggaacggattgacgtgatttatccgccgggcggggacgccgcattgacagaacggcgtccgaaaacaggcgaagcgggtcggttcagcgtagaatatgtgatcaccttagctttgcacggtaaggatttttcagttgaacatttcacatccgagccgattccgcaatcccttcaaaaaggatttgagcggattcaccgcagctgcgatgaccaaattcagccggctgacaacgccgttccgaagggccgttttacaattgtacgggtcacggtttccggcggtcatgtctatgaagcacgtatcgactgtccgaggggagcgccgggaaacggtctttctgaaaaagatattgaagacaagctccggctcgctttgccgggagaagagaaaaaggcggaagaattgatcaaagcagccggacaatcaaatattgaccgttatttacagctgatataaataaaaagagcgaggggatgcagccctggctctttttacgttcacttctattgaatagggggatatagggtgcgcccctgtctgcgctggcaggggcgcggtatcaggaaacggccgtgccgttttctttgaccgtgaaacttcctcttgataagcggatgttgatatcagacactttggcaatttgttcgtcgtgcgtaaccatgatgacgcatttgccgtctttatgcgccagatcctgaaagagccggacgatttcctttgacgtatcctcgtcgaggtttcccgtcggctcgtccgcgcaaatcagatccgtatcacagcagaaagcccgcgcaattgaaacgcgctgctgctgtccgccgcttaatgtcagtacccgctgacgggcctgctgttcggtgatgccgactttatccagcatgctgagcgcggacgcatctttgttgttctccttagatccggtaatctccatcgcggttgtgacgttctggagcgccgtcatatacgggatcagatgatgagattgaaagacgatagagacatattgatttctgaatttggttaatccgattttggagatgtcttctccgttataaaggatgcttccctctttaggtgtgtcaaggccgcccgccagagacagaaacgtggtttttcccgttccggaggcgccggcaattgtataaaacttccctttttcaaagctgatcgttatatcctgaaacagcggctgtgatttatcttggtaccagtagccggtctgttgaaaggttaataggctcattatgctgcctcctcttattcctgcttggtcaggatcgttttagggtgaagccgcatgactgatacagacggcagtaatgtggcgatgacggcaattgcgacgccgatcccgccgagaatcagaaggtcattcagcgaaacgtttacctgcattgtactgatgacatctgcaccggatgaatgctgaccgaacatgccgtctccccgcggcatttctcctccgccccagccgcttgtttgctgctgggaatcatcggctgagctgacctgctgggaaagaagctgatttccgagctgattcgccacaaggctgcccgtgacggatgcgatcccgatggcgataaccgcgacaatcagaatttccgttaagaattgtccgatgagcttccagcgcttttcgccgatcgccatcaagacacccatttcatacttgcgttccctgatcgacatcatcacgatcaacccgagaatgaccgcgcccgcgatggatacaaggtacaccacgtttttagaaaatgacgcgacattttcaatcgggccggccatttgctgatacacctgatcatttgtcgtcagcgtgtaggttttatcatctatagatgtttttttcgcagccgcaacgaatgagtcaatatattttgcatcatccatataataaacggctgagctgattctgtttttgttatcagacccttttaacgccgccgcggcggtgtaaggcgtatagattttattgtcagggtttaagaatgaaaaatgctctgcctgatcgtctcctgatgatgttgttttatagattcccacaattttaagcttcgtactcacagaatcatccgctgctgaggaaactgtaatggagcctccgaccttcagcttgttttgatctgccagcgtttcattgatcactgcgacttttgcgtccgcatctgtttttgtgatggcgcggccgtcagtgatttttgagctcccgcctgtgaaatcatcaagcagcgccgtagagagcacgccttcgaccgaaatatccgctgaaatcatctgtcttccgccgccttgaaaacggcttccgccggagctgttatcggctgattcgcctgagctttttatcgcgtcaaagctttctgcgtttgctgacgctgtcgtgaggaagttgtaatttttaacgtgctgtaaagatgtaagtttcttggcatccgagacggaaatcggcgttgattcaaacgtcctcttttcaccgtctttttgctgctgcgccatttgcttttggcggtcagcctggagtgtgacgctcccgccgagctgctgccttgccagttcgcttgatttcttcgccgctgactggatcgtaagaccggacaggacaaaaatgcaaatcactgaaaacacaaccagctgcaaaaacgtttttcccttttttgccttcatgctccaaaaggctctttttataaagttcatgtctgttcctccgtgtgggtgtcagatcttgtaaaaccagccttctttagaaccggttatccgatatgtatatagtaggagaaatgtatgaaaaaaatatgaacaaactatttccgggtgatgaaataaaaactaacaattgtgaaacgcgaaaatatccgggtaaaatggtgctattataagtaaaagcgtcaagataaacggaggacccaatgaagatattaatgatagaagacaatataagcgtatgcaccatgacggaaatgttcttttttaaagaaggatttgaagccgaatttgtccatgacggagtggaaggctatcagcggttcacggaagaggactgggatttggtcattctggatattatgcttccatctatggacggagtgacgatctgccggaaaataagagagacgagcagtgtgccgattattatgctgaccgcaaaggacacggagtctgatcaggtgatcgggtttgaaatgggagccgacgactatgtcaccaagccgttcagcccgctgacgctagtagcgcggattaaagcggtgatcagaagataccgggcgacggggcaggccgtaaaaagcggcgacttgatcgaaacggcgtgtttttcaatcaataagaagacgcgggaagtgtttctgcatggaaagcctgtcgagaatctgacgccgaaggaattcgatctgctcttttatctcgcacaaaatccgcgccaggtcttttcgagagagcagctgcttgagcaggtgtggggctatcaattttacggcgatgaacgtacggttgatgttcatattaaacggctgcgcaaaaaactgtccagtgaggaaaaaccgtttttatacacggtgtggggggtaggatacaaatttgatgaggattaaatacttatatcagctgctgttaagccatgtcagcattttgattttggcctttttcattatcatttccctgttttcgcactttgtgaaagattttgcgtatcaaaataaagtggatgagctgtcttcttacgcccagcagatcacaagtgagctgaacggacgcgatcttgatctgcgccgcctgtatccgtatcaggacatgttaaaaacgcgcgagaccaggtttattatttttgatgaacatcagcggccgtacttttttcctgacgatatgccgccgcgcgagaagctcaaaagtaaagagtggcacatgctgaagcaagggaaaaccgttcagatcagagcggagatgaaccgttttaatacggagggcttggaagtatcgcttgtcgcaaaaccgcttttgatcaacgatcaatttaaaggcgcggtgctgctcgtgtctcccgtcagaggggtcgagcagatgatcagccaggtcaaccgctatatgatttacgcgattatcagcacccttatcatcacgattctgctgagctggcttttatctaaatttcacgttaagcggattcagacattgcgggatgcgaccggaaaagtggcatccggggattacgatatttcgctcaagaacagcggcggcgatgaaatcggcatgctggcgtccgatttcaacatcatggccaaaaatctgaagcaatcgagagagcagattgaccgcctggaaaaacggaggcgccaatttatcgccgatgtctcccatgagctgagaacgcctttgacgaccattaacggacttgtggaggggcttaacagcaacaccatcccggaaaaagataaagagaaatgcttctcgctgatcagtgaagaaacgaagcggatgctcaggctcgtgaaagaaaacttggattatgaaaaaatcagatcccagcaaatcaaactggacaagctcagtctgccgctcatcgaggtgtttgaaattattaaagagcatctcaatcagcaggcggaggaaaaacaaaatcagctgcggattcaggcggaggacggcgtcaaagtgttcgccgattatgacaggctgatccagattctcgtcaacatcacgaaaaacagcattcaatttacgcaaaacggagacatcacgctgcgcgggtatgaaggctataaagaaacggtgattgagatcgaagacaccggaatcggcatctccaaagaggaaattgagcatatatgggagcggttttataaggcggacgtgtcccggacgaatacggcatacggcgaatacggactcggcctgtccatcgtcaggcagctcgttgaaatgcataagggcacgatagatattgccagcgaaaaaggaaaaggcacgacgtttacaatccgccttccgctgaatacgaaacatgaatcatcttgaaaccggcagtcccgtctggctgccggctgttttatcttcactcggaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaaaattaacgagtggtatcgatacatcagaacattcagcgtgccggatgcggagatcttgaaggccgagatcaaacaagagcttgaccgtatggagcctgattcaaacttagtgctttattattccctcatggaatttcgccatcagctgatgctggactacttggagccgctggaaaaactgaagatagaagaccagccgaccctgtcggaaattcttgataacattgataacagccaggccggcctcaaagggcttctcgattattacgtcaactttttcaaaggcatgtttgaatttgataaaagagaatttatctcagcgattacatattataaacaagctgagaaaaaactggccttcgtatcggaccacgtggaacgggcggagttttattttaaagtggccgaagcttattatcatatgaaacaaacgtatttttctttgatacatataaaaaacgcttatgaaatttacgtagagcaggacacatataacgtcaggatcattcaatgccattttgtattcggcgtcaatttaatggatgaaaggcgctttgaacaggcggccaaacattttcagcacgctttgcaaatggccgaaaaagaacaaaaagcgcagcttgtcgggagggcgctgtataacctcggactgtgctactacaatcaggaccgcatcggcgaagcgattccgtactttgaacgggcggttgatacatttgaatcacaaagaatcgtcaattctcttcctcaagcatatttcctaatcacactcatttactttaaactcggaaaaaaagaaaaagcgtcggaatatcacaagcggggatatgaatatgctaaagaaacagacgatcccgtttacacggtaaaattcgaatggctgcaggctctgtatcaggcgaaaccggatgaggaaaaaatcagcgcatgtttccgttacctggaagataaaaatttatacgccgatatagaggatttagcactagaagcagctaaatattactatgaacaaaattgctttaagatttcttctgactattttctgaaagtcgaagaggcaaggaaacaaatacaaaggagtgagggtttgtatgaaattgaaatctaaatggtttgttatttgtttagcagccgccgcgatttttacagtgacaggtgcaggccagacagatcaggctgaattccatgtagctgaaagaggaatgacgtgagaagaaaataacctgaacaaaggaaaagactgcccgggaatgttcccggcagtcttttttttgcgcggccggacttggacagcggcggaaaacaaaagaaaacgccgcaggtcaaaacccgcagcgtcctcatatagacggagtgatgcttagaaaccgccaacataggcagtacctacaataaccaacaggataaataaaacaacgatcaaagcgaaagagctgattccagaatatcctgacatgagcttcacctccatattgtctataccatacaatatgtaaaagaagctgctttgtaagggatattagtggacaagagaaaaaagaggcggtgtcctatgggagtaagactccggcgaaaaactcgtcatacagcgcccgcaccgcttgtttttcctgttcttctttcaccccgaacatcatgctgacttccgatgacccctgattgatcatctcgatgttgacgccggcttcggacagtgctttggatgccctggcggttgtgccgacattatggcgcatcgcttccccgacgaccataatcagcgccagattgtgcctgactgtgacttcatctgcttgaagttcctgcttcagacgggtgacgagcctgtgttccagttctgagtccatctgatcgtgccgaaggatgatcgtgatgtcgtcaatgccggatggaacatgttcatacgtcaatccttcttcctccaaaatgtgaagggctttgcggccgaaaccgatttcccggttcattaaatatttgcttatgtaaatgctgcaaaagcccgtgtcgcttgcgatgccgatgactggcccgttcgtattgtcacggctgctgacgacgcgcgttcctttcgcctccggattattcgtattcttaatctgaacggggatgccggcccgaaaagcgggaatcagcgcttcatcatgaaaaacggaaaacccggcataggagagctcacgcatttcccgatacgtcagttcgttaatctctttcggatgccgcacgattgacgggttgacggaatagacggcgtccacatcagtaaagttttcgtacaggtcggcttttaagccgctggcgagaatggagccggtaatatcagaaccgctccgggaaaacgtcacaatctcatgctccttcgtgtaaccgaaaaatcccggaaaaatgatcaagccttcacggtttctcagacggtacaaatgatcataagactcagggagcacctgagcgcttccgggttcattcgtcacaaacagccccgcttctttcgggcttacgtattcggctttcacgccctgccggcggaagtaggccgcgatcagcttcgcgttgttgtcctcgccgctcgctttcaccgcatccatatactgatcgggattggctttgctgctgtttaagagagcgaataggtcactgcggattctttctataatagagaaatccaggttcagctcacgcgcgatggcggcgtaccgttcaatgaccggttcggcaagctcgggcgctgcaccattttgcaaataatgctccgcacagcggattaacagatccgtcacctttgtatcgtccgagaagcgttttcccggcgccgatacgacgacggctttccgcgagggatcagccgtcacgatttgaaacactttctcaagctgggctcctgacgcaagagagctgcctccgaattttacaactttcatgatttacatcccctaatatttaaattttctcacaaatttaatttttattatctctctttcaaacatgtaaatcaaggattttttctatgtggggagaacatttgtattttcttggaggaattttgccgctgtttgtcagatttgtttcccgcaagcgtgtcatcatgtgcaaaaaatgataagcagccaaatgaaggttatagaaaatcctgcaaattcttgatagactgattgtaagacaatttagtgtacggcccgcggatgaccgtttttgaaagcaaaactgtattgactgcgcttggaaagatgataagattatagttgtcgttgataatgataatcattacgagtggggatatatgggagttgtttggcaatcagtcataccgtttgtgatgggtgcagggaggcagcatgaagctacgttacttacttttgctactggcggttttggcgtgtacttctatatttatcggtgtagaagatttgtcgccgctggatatttttcatttaaataaagaacaggcaggtacattgtttgacagccggctgccgcgtttggtgagcattatcatcgccggcatgagcctgagcatctgcggattaatcatgcagcagatcagccggaataaatttgtatcgccgacgactgcgggaacgatggactgggcaaggctcggaattttgatttcattaatgctttttacgtcagcgagcccgcttgtgaaaatgtctatcgcttttattttcgcgttggcgggaaatttccttttcatgaaaatcctcgagagaatcaagttcaatgatgcgatttttattcctctcgtcggtttaatgcttgggaacatcgtcagctcaatcgccacgtttatcgcatataaatacgacctgatccaaaacctgtcatcttggctgcagggagatttctcactggtcgttaaaggccggtatgagcttttatatctgagtatcccgctggtgatcatcgcttatgtgtatgcggataaatttacggtggcgggaatgggagagagcttttccgtcaatctcggcctgaaatacaaacgcgtcgtcaatatcggtctgattatcgtgtcgctcatcgcttcactggtgatcctgaccgtcgggatgctgccgtttctcggtttgatcattcccaatatggtgtcgatttacaaaggggacaacctgaggagcagcctgcctcacacagctctcttgggcgctgtttttgtgctgttttgcgacattttgggaagggtgatcatcttcccgtacgaaatttccatcggcctgatggtcggtgttatcggcagcggcatcttcctgtatatgctgttaaggagaaaagcatatgagtcataataaaaaaattacgctgctggcggcgctcgccataatatgtatcggattctttctgttctacggactgggcaattgggaatactccctgccgagacgatgcttcaaagtgcttgccatgatgctcacagggggagcgatcgcgttttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaatcttaatttcgtcatctccgtcggactgatggtgctcttgtcactcgttttgtatcagctcatgtttaaaggcgaggggcggaacgtgtttttccttctgcttgtcggcgtcgtgttcggcacgctgttcaacagtctgtcatcctttatgcagatgctgattgatccgaatgagttccaggttgttcaggacaaaatgtttgccagctttaacaatatcaacaccgatcttttaggatttgccggtgctgtctttcttctgacaggcatttatgtctggcggttcacgcggttttttgacgtgctgtcgctcggcagggagcacgccgtcaaccttgggattgattacgataagcttgtgaaacagatgctcatcgtcgtcgccattcttgtgtctgtctctacggctcttgtcgggccgattatgtttttaggactgcttgtcgtcaatctggcgagagagtttttaaaaacctacaggcacacgtatttaatcgcgggttccgtcctgatcagcatcgtcgcgctcgtcgggggccagtttgtcgtagagaaagtgttcacgttttccacgacgctgagcgtcatcattaattttgccggcgggatttattttatctatctgctgttaaaggagaataaatcatggtagaggtcaaaaatgtaagcaaacaatacggagggaaaaccgtccttgagaaaacgtctctatccattcaaaagggcaggctcacctcgtttatcggtccgaacggcgcgggaaaaagcacgctgctgtctatcatgagccggctgattaagacggattccggagaaatcacggtcgacgggcaagagatcggggcctgtaaaagcaacgatctggcgaaaaaaatcagcatcctgaagcagacgaaccaaatcaatatcagactgacgattaaagacctggtcagcttcggcagatttccgtattcccaggggaaactgacggatgaagattgggtgcatatcaaccaggccctcagttatatgaagctggatgacttaaaggataaatacctcgatcagctcagcggaggccagtgtcagagggcgtttatcgcgatgatcatcgctcaggatacggactatatttttctcgatgagccgctgaacaatttagatatgaagcattccgttgaaatgatgaagctgttgaagcggcttgtggaagacttcggaaaaacggtcgtcgtagtgattcacgatatcaacttcgcatccgtatattcagaccatatcgtcgcactgaaaaacggacggatcgtcaaagaagggccggcggaggagatcattgaaacctccgtgcttgaagatatttatgatatgaccatcccgattcaagagattgacagtcagcggatcggtgtgtacttttcttaaaaaccagatgaggtgaaagtcatgaaaaaattcgcattgctattcattgcgctagttacgatttttgttgtttctgcatgcggaaacggggacaaaacatcaggcaaatcaaaagaaacaatcacaatcaaagatgatctgaacaaagaaggagtcaaagtgccgaagaatccgaaaaaagtcgtcgtattcaacttcggaatgctggatacgatggatgaactcggtttacaggatcacgtggcgggacttccgaaacaaaaccttccaaaatacttatcttcatataatagtgataaatacgccaataccggcggtttaaaagaaccggattttgaaaaagtcgcggatattgatccggatttaatcattatcgcccacagacaatctgattcttataaagagttctcaaaaatcgcgccgacgatttatcttgatgatgactatacaaactacgttgacagattcaagcaaaacactgaagtgatcggcaaaatctttaacaaagaaaatgaagtgaaagataagcttgcgaaaattgacaaatccattgccgatctgaagaaaaaaacaagcagcacggataaaaacgggttagtggtgatggcgaacgacggcaaaatcagcgcgttcggatctaaatcaagatacggcttcattcatgatgtgttcggcgtcaaaccggctgacaaaaacatcgaagcctcactgcacggacaaagcatttcctatgaatatatcgccaaaacaaaccctgattacatgtttgtcgttgaccgcggaacagcgatcggcacaaaatcttcaacaaaacaagtggttgaaaatgattatgtaaaatcggtgaaagccgtgaaaaacaaccatgttgtctaccttgattcagctacatggtatttatcaggaggcggcctggaatccatggcgcaaatggtgaaagaagtaaaagacggaatcgagaagtaaaaaaagaacccggtcacatacgtgatcgggttctttttggtttaccgcgtaacggcctgctgctgctcgggctgacgcggttttttcttcaatgtaaaagataggaggaagccggccagcgcgatgcaggcggctacgacaaaggccgcattcatgccgtgcagggcggcgtttgccggagttgacgcattggcgtgcgcggcctggctgctcatcacggaaaccagcagcgccgtaccgatagaaccgccgacttggcggacggtattgttcatggctgtgccgtgcggaattaagtggcgcggcagggcgttgattcccgctgtcgtcaccggcatcataatcatggctgttcccaaaagccgcgcggtataaacgacgacaatccaaatgagagacgtcgagtccgtcagattcataaacggcagggacgtgagcaggatgatgaagaatccggtcatcgcaaggccttttccgccgattctgtcaaacacccggccgataaacggagacatcatccccatcacaatcgcgcccggcaaaagcattaatccggtatcaaacgcggagacgccccggactttttgcgtgtaaagcgggagaatggtttccgttccgatcagcagcgcgaaaacaagcgttccgagcagggtggtcaggctgaaaatcccgaaagaaaacacacggaattccagcatcggttttttgagcttcatctgtcttgcgataaagaaaatcagcgcggccgctccgacaagcagcgaagtcagcacttcagtactggtccatcctgaggaaccggcgcttgagaagccgtaaagcagcccgccgaatccgagggtcgataggatcacggataaaatatcaatctgtgtttctcgtaatgtcgtgacgtttttcatcagaataattgctaaaagcaaatcgatgactgcgatcgggaagatgatataaaacaaagaccgccaagagaatgcttcgaccgcccatccggaaagcgtcgggccgatcgccggcgcgaacgaaataaccaagccgaccatacccatggcgcggccgcgcttttccatcgggaaaatcgtgagaaataccgtctgcatgagcggcagcataattccggcgccggccgcctgaataatccgggccgttaagagcaccggaaagttcggggcgaatgcgccgacaatggtgcccgccgtgaaaatactcatagcggaaatcaggagggtgcggctcgtaaatttctctattaaaaatgcggtaatcggaatcaaaatcccgtttgtcagcataaacgacgttgtcagccattgcgctttgttggcatctatattgaagtcattcataatgtgcggcagcgccgtgataagcagtgtctggttcaaaatggcgacgaacgctcccgccaaaagaatcccgacaatgacagagcggttgtatggtgcagttttaatactcttattcaagctgattccttctttctttatagtttgagcaatgttttaacggctgcaagcggctggtgcagcggtccggcctgctccaaataaccgatgagcgcttttataagaaaatcccgcggctgtttgtccgctgattctttctccagcataaccgccgcggaagcgagtcctgcggcatcatatttttcctccggaagggctgagacggcttctttcagttccttcaggctttcagccagcaatacggttttgtctttcggctcaaatgaggaagcggaggcggtataaaggtcaatcatctcctgaggcaaagcggtttcggttttcctgttttcgacgatgagattgagatggcggatgataaagtccgtgagcggctccagggcgagcggttctttttccagcttaatcagcgtgatgcattctctcaggagcccctgcaggacgatcaccagctcccatacataaggaataatgtcttcgccgtacgtctgaatcagtgaatcgcgatgccagcagataaaggtggagcgggccctgtgaatatgccgttttacccgctcattaatggaagaggggcttccgtacatcagcatattaaaaaactgctggttgcgcctgaagccttcaagctcagccatcagttttttggcaaaccgttcctcaggggagaggctcgtttcttcatttaataatgaagcggccgctaccatctgtttctggttaaaatcgagcagctccaggagcaggtcttcctttgattcaaacagcttatacaaagatgctttggagactttgcactcctctgcgatcgcctgcatcgagaccgacgaaaagcttttcccggaaaaaagcttccttgccgccagcagaatatccgttttcttatcattcataagcccagattccttctttcgtcacaatagaaaacccatcagttcacagaaaaccaatgagtatatgatgaaaatattaacaaaaatttttacatagtgtcaacgcttttgtttgagaaatagaaaaaacctgccggagtgttccgacaggctgatacgtttatttatccgtcttaaatccttgtttttcaagcatttcacgaatgtgaggatagtaaacctgcttatagtaggaagtgatgccttgtgaccagtttcttgtttcctgtccgtcggtgcgttttttcatgtattcggacatctgcttgtcataggcctcgatatgggttcttaaatcttcttcttgatacgtttcatgatgcagaacggctgcttgcggcagacgcggttttttcgcggagcggtctgccggatggccgatgacgagaccggaaatcgggaaaacgtatttcggaagtttcagcaattcaatgatttcgtcaggcttgccgcgcacggcgccgatcggcacagtgccgagtcccattgattcagccgcagccgttgccgtacccagcgcaatcccgacatctacggctccgactagaacggactctaaaccgttcgtgatctcaagcggtgtatcattatattcttcaagcgcaattttggcgcggttaaaatcagcgcagaataaaaggaaaacaggcgcttggtcaatccacggctggccgccggccaattcggatatttttttcttccgctccttatctttcaccgcaataacggtaaattgctggccgttaatggaagtcggcgctgcctgagttgcttggatgataaggtccagctgctcatccgatacgggttcatctgtgtagctgcggatggaacggtggtctgttaatatttgaaggacttcgttcatgtcattcatcctttcgttactctgacagttctgtgcggacgacgtcaagcggcgcactcagcacttcttttgcttttgccacgaatccttggaaatggtcagttgcgttgtggaatttcatcgcttcttcatctttccattgctcaagcataacgaatgtattttcctcaccgactttttcgaaaagatcgtattgcacatttccttcttccgcgcgtgaatgctgaacaagtgattgcgcttctcctaaaaattcctcgcgtttatccgcttttactttcatgtaagcctgtaagacgatcattgttattcctcctgattgggtttatttgttatagttcgaatattatcgaactaactgtaacatgtttcgcagtgaatggtaaaggaaaaaccctcaccgcctaaattgtcacccgccgcttttatgtgttacatttgactcatgaacattccaaaccatcctgaaaccgaccgcttacagctgacaaaggttcttcatgctctgagtgatccgctccgcttagagctggtcaaacaattggcggaaacaacagaaaaaacgtgcggtacctgcgctgatgtccgggtcgccaaatcaacgctgtcccatcacttcaaagtgctgcgggaagcggggatcgcccaagtgcgcatagacgggaagcaccgttattattccctgcgcaaagatgatttacaagcggcgtttcccggcctgctggaggcgattttgcagacagaaccggaccgctggtaaataagtccccgaattccgggggtttttttatgcgccgaaaaccgcccggtaaagcctgaggacgccatcttgaatatcgctctccttcaggcgggcaaaccccagaatgagctgcggcttatttgaatcgcctcccgctttcagacggaaccggctcatcgcaaacagatcgagctgttctgcatccgcccgtgccaaaatctctttttctgaacgggcgcagtcaaactcagtgacaaaatgaagccccgcattggcgccctttacactgattctttctccgaatgtttcttccaaagccgaaatgaggcgttcccgcatgttcttataatgctgcttcatctttttaatatgtttctgatattcacctgagtcgataaattctttcagcgcgagctgggcaagcgtgctgcacgtatgcaggtcatacgctctctctttgaacgtccgcaaaagcccgggcggcagaaccatatagctgatgcgcagacctgggaaaagggattttgaaaaggtccccatgtagatgacattttgaaaccggtcaaggctttgaagcgccggtatcgtatcggcgtcatatttaaattcactgtcataatcatcttcaatgatgaagcggccgttctgttcggcggcccagtttaaaagctgaatccgccgggaagcgggcatgatcacgcctgaggggaattgatgggaaggcgtggtgatcaatacacagggccggcgtttttcgatttcggccatggacatgcctttttcatcaaggctgatcgtcgcaacctttttcccgaggttttgcagcagccggtacatcctcatatatcccgggttctccatggcgtacagcgcgtcgtttggcagcagttccgtcagcagctgcgtcagcatttgcgtgcccgccccgagcacgatttgttccgggcggcatgtaacgcctcttgtcagggaaataagccgcgaaatggtttcacggacttcatataagccttgcggatggacgagttctccgagtgtatgaaatgaacgggcggctgctttatgctcacagcggaaccagcttttcaagggaaaatgcgccgtatccacgctcatatgagaaaacgaaatccagccgctcttatccggctcccgctcttttaaatcttcaggcaatgagagcgaaggggtttcttcatgataaaccgtatcaatttcctccacgaaaaagccttttctttcgactgcatataaataaccttccgaaagcagctgctgataagctgaattcactgaattcacgctgaccttcagcgtctcggcaagctcccgtttagacggcacctttgtatgaggcatcaggctgcgtttcaaaacggccgcttttatgtgctgatagatctgctgatagatataatccgccgtttccgaatgatcaatggaaatcgtcagcatccagaccctgctcctttctgataccatggataaattgattttggtacttttcatcataccaaaaagaagacagaatgataagaaaacaatatagggggatggaatctatgagtcgaacagcatcatcggaagtgacaactgcccagtggcagcaaaaacgggatcaattcgtttccaagggggtcggcaacggaaaccgcagcatggcggtaaaaggggaaggggcgcttttgtacgatttggacggcagacgattcattgattttgccggagcgatcggaacgctgaatgtcggccattctcatccgaaagtggtggaggccgtgaagaaacaggcggaggatctgattcacccgggatttaacgtcatgatgtatccgtcttatattgagctggccgaaaaactttgcgcccttgcgccgggagatcatgcgaaaaaagcgatttttctcaattcgggggcggaagcggtggaaaacgccgtgaaaatcgccagaaaatatacgaagcgccaggctgtcgtgtcatttacaagagggttccacggccgcacgaacatgacgatgagcatgacgagcaaggtgaagccttataaatacggtttcggcccgtttgcctcagaggtgtatcaagcgccgtttccttactattatcaaaagccggccggcatgagcgacgagcagtatgacgactttatcatcagcgctttcgaggatttctttatcgccgcagtcgcaccggaaaccgtcgcctgtgtcgtaatggagccggttcagggagaaggcggcttcatcattccgtcaaaacgtttcgtgcagcacgtcgccgctttttgtaaaaaacacggtatcgtttttgtagcggatgagattcagaccggttttgccagaacaggaacgtattttgcgattgagcatttcgaagccgttccggatttgatcaccgtatccaaatcacttgcggccggattacctctgagcggtgtcatcggccgggcggaaatgcttgatgccgccgcgccgggggaactcggtggcacatatgcgggaagcccgctcggctgtgcggctgcgctcgcggtcttggatattattgaagaagaagggctgaatcagcgttccgaagagatcggccggatcatcgagcgtcaagcgctcgagtggaaaaaagagcatgcctgcatcggagaagtgcgcagactcggcgcgatggcggccatcgaaattgtcaaagatccgcacacgcgggaaccggataaagcaaaagccgcggcgatcgctaaaacggcgaacgagaacggactgctgctgctgacggccggcattaacggcaacattatccgattcctgacgccgcttgtcgtgacggatgagcagctcaaagaaggcctttccattatcgaagcagctctgtgagttcaattattggaatcccgccggatgtgtctgctatcatgaaagtgtgagatacatcaacaagcattcaatggttttactataggaaagaaaggaatgttcaatatgccagaacaattaacagtgtacaacccggcaacgggagaggcgatcgaaagcatcccccagcagacggccgaagatgttgaaaaagcgattgaacgttcacatcaagcgtttcaatcatggtccaaaacatcagcgggagaacgtgcctcacttttgagaaaatggtatgagctgattgttgaaaataaagaagaacttgcggaattaattacgaaagaaaacggcaaaccgtacgaagaagcggtcggagaagttttatacggcgccggctatattgaatggttcgccgaagaagcaaaacggatttacggcagaaccgtacctgcgccgacaacgggcaaacggattgtcgtcacccgtcaggcggtcggaccggtagccgcgatcacgccgtggaatttcccgaatgcgatgattacaagaaaagccgcgcccgctttggcggcaggctgtacgttcatcatcaaaccggcggaggatacgccgctttccgcttacgcccttgcgcgtctcgcatatgaagcgggaattccgaaggacgtgctgcaagtggtgatcggtgacggagccgaaatcggaaacgtcttcaccagcagcccgaaaatccgtaaaattacctttaccggctcaacgcctgtcggtaaaatcctgatgaaaaacagcgccgacaccgtaaaacatatgtcaatggagcttggcggacatgcgccgctgatcgtggatgaagacgctgatcttgatctggcggtagcccaaacaatggcctctaaattcagaaatgccggccaaacctgcgtctgtgcgaaccggctgatcgtacacgaatccgtgaaagacgagtttgcgaaaaaactgagtgaagaagctgcgaaactcaaagtcggaaacggtcttgaaaaaggcgtaaacgtcggccctgtcatcaacaaaaaaggcttcgataaaatcgtcggccaaattaatgacgccgtggaaaaaggtgcagaagtgctgacgggcggaacgtatgaccaaaacgacgaaaaaggatgctatttcgtgacgccgaccgtgctttcaaatgtagatacatccatgaacatcatgcatgaagaaacattcggcccggttgcgccgatcgttacgttctcagatattgatgaagcgatcaagcttgcgaacgatacgccgttcgggcttgcggcttatttcttcacagaaaactaccgccgcggcatctatatttctgaacagcttgaatacggcatcatcggctggaatgacggcggtccgtccgcggttcaagcgccgttcggaggaatgaaagaaagcggcatcggccgtgaaggcggtacggaaggcattgaaccgtacctggaaaccaaatacatgtctatcggactttaatgagccgaaaagaaagccccgcttctaagcggggctttttttattgagcggtctgccggtgaatatcgccggcaggcttttttgatcttgcgggaataatcggttcgattccagacaaaataacagcaaatacgattgaaagaaggtcgccatcatggatatattactggctcttctcccggctttattttgggggagcatcgtgttatttaacgtcaaattaggcggcgggccttacagccagacgctgggaacgacaatcggggcgctcatcgtttcgtttgtgctgtatctttttgtccatccggtgctgtccgggcgcatttttattgtcggcatcatctcggggctgttttggtcgctcggccaaagcaatcagcttaaaagcatacagctgatgggcgtttcaaaaacgatgccgatatcaacgggaatgcagctcgtctcgacttctttgttcggtgtgatcgtattcaaagaatggtcaaccccgatcgcgattacgctgggtattctcgcccttatttttatcatcatcgggattgtgctcacatctttagaagataaaaaggggcgggcggacggagaaccgggaaacttaaaaaaaggcattgtcatcctgctgatctccacgctcggctatttggtctatgtcgtcgtcgcccggctgttcggtgtatccggatggtcagcgcttctgccgcaggcgatcgggatggtcatcggcggactgctcctgacgtacaagcataaaccgtttaataagtacgccctcaagaacattctgccgggaatcatctgggcgctcgggaacatgtttctgttcatctcacagccgcgcgtcggagttgcgacaagtttttccctctctcaaatggggatcgtcatcagcacgctcggcggaatcttcattctccgtgagagcaaaacgaagcgtcagctggtcgccattgccatcgggattatcctgatcattgtagccgcggtattcttaggcgttgcgaaatcaaattcataacatatgcaggaggtttgaacatgtacacggatttaaaaggaaaagtcgttgccattacgggagcttcatcaggattaggaaaagcgatggcgatccgcttcggacaggagcaggcgaaagtcgtggttaactactatagtaatgaaaaagacgcccaaaccgttaaagaagagattcaaaaagcgggaggcgaagcggtcatcgttcaaggagacgtcacaaaagaagaagatgtcaaaaacatcgtgcagaccgcagtgaaggaattcggcacattggatgtcatgatcaataacgccggcatggaaaatccggttcagtcgcatgaaatgccgcttaaagactggaacaaagttatcaataccaatctgaccggcgctttcttaggaagccgcgaagccattaaatattacgtagagaatgatattcaaggaaacgtcattaacatgtcaagcgtacatgaaatgattccgtggccgctgtttgtccactacgcggcgagtaaaggcggcatcaaattgatgacggaaacgctggcgcttgagtacgcgccgaagcgcatccgtgttaacaatatcggaccgggcgccatcaatacgccgatcaacgcggaaaaatttgccgatcccgttcagaaaaaagatgtggaaagcatgattccgatgggatatatcggtgagccggaagaaatcgcggctgtcgccgtctggcttgcttcaaaggaatcaagctatgtgaccggcattacgctgtttgctgacggggggatgaccaaatatccgtctttccaggcaggccgcggataagaaaaaaagcgatcgcaggctctttagagccggatcgctttttgcttacacacgttttttctttacaagcgccgcgatggaaaggataatcgccgcagctgacagaacgatggccgcaatatcaagcgctgatacgccggatttgctttcttcgtttgactgttcagctccgtgcgcatccgtcacgctcgccgatttcgttattttcgtaatcgagtgaggcgtgtcggctttctcatcacccgtccattctacaatgctgccgtctttgtaatattggtaagcgtcccaagcggcatctccgctcttttcaggatttttcgcaacgaacgtgaactgctggaattggccgggctgaatgccgccgtcctttgcttcccaagtgacggagaccgctttgtcatcatgtttggatacggatgttttccagcccggaatcggctgatactgctgaaattcaacgccggcgggcattttcagcacgactttcgttgtcggctcattcttttccacaggcactttcatcgtgtacgtttcccaagaaccggccgcggattccgcgggtttgactgagacgtgggcgcttgctgcagccgtaaaaccgacgagtgacagggtcacggcggatatgaatattaaagccttttttttcaacatgagatacactccttagtttgtcgttgagaatatttggttgatttcattaaaatcgtttgtcagtccgtggactttgatcttccagtttcccttttcggtgatggacaggttggcggcttcgaatgtgccttccttcgtcttcttcaaatcaaaggtgctttcatgctgtttgccgctgaagcccgtctggtaaacagtgaccgtaaattgctgaatgtcttttactaagctgccgttatgatcggtgacaatgacttgaaattcatttttacccggctggttcggcgtaatgtgcaaggatagggtttccccgtttccgatcgtttctgagccgttaaaaggcaacggcgcgggcggaggcggactgggcaggcttgtgaagacggcggttgtgaataacaccgcaatgcctagtgcccattcggcctttatcgttgcgctgatgctcctttttctgctgaacttcgtcatccatacgtgaacggcgccgagcgcaagcatgatgacaaacagtccgattttcaaaaggagcgtcttgccgtaagcggtgtgaaagagtgaatcgaacgagcggataatgaaaaatccgttcagcactcctgaaaataacagcacgccgacagaggcgaacgcccaaggagaaaaccgtctgaccgtttcccaagcgatggttttatcgggttttctccactctgatgaaagaagcagcacaagcgcggcgataccgcccatccatacagacgcggccgataaatggagaaagtccattgcgatgccgaccgctttttcgtcgataacggccgcatgcccggcgaatgcttttgccaaaagcgaagcgaagaagaataacagcggcgccgtccagtacgcaaatgaccggaatgctttcttcttcagcagcgggatcatggacagggcgagcaggataaataagctgatctggatcatccagacgtacccgcctgccgttttcagaagcgtttcttttacatagtccggctgaaacgcggcgctccaagcgccgcccgcgttttctttcgtctggatcgggagctggcacacgagcgcgagccccgttaaacataaagaaatcacgagcagctttacagttcgttttgcttttgatgaatcttcattatttctgtaccaaaacagatggaaaaaagccgtgccgataaacagggagagagcggtgtacaaaataccgcggtcgatggccgcttcgggatgaagcgccgcttgcgatgatgtctgctcctgaagttctccgccggcttttccgatgctgaaagggatgacgccggataccggatgtccgtcggccgataccgcgttccattccgctctgtaaatatcatgcggcagattttttttcaatgccgcggtcatgatgcgggcattatttttttgaatcaccgttttgcccgcgtcaacccgttcaccggatgaattatagaccttaatggagtggaagccttcttcaatctgttcattaaactcaatttcaatctgcttcggcgcttgttttaattcgctgttctcacccggatttgagtttgtgatgtaggcgtgggcgaagcttgttttcggaatcaaaacaaggaacagcaaaaagacgagccagcgtttgttctgtctcatggatgatgacaccgccttccggttggttgttgttatgtcttgctgcaggtgcatcccttctgcctgtcgtgtaagatgatgtccgccgcctcgtcaaaggtgcaaatgaccccgccgaatcctttttgaaaccgttctgcgtaatcaagcgttgagaagggaatcgcctgaggccggcagcagtgaaggtcaatatcggcatggactaaaaagtatgcggaagcggccgtcagcgtcgtctgaagaagaaaatccttacaaatgacgtgggacacttcttcctttttatcctcataccgcaaaattgcgcaatgaatgcagcacatctgctcaacggtttgtgaaacggtaataagctgaacagaatacgaatgctgaatcggccgcaggcaatagccgcattgattggcgcttcgttctgaagcgggagggagcgtaatgccgccgggtgtccggataatccggtttgcatccgccagctgattgacgtctctgtacacggtcatctcggaaacgccgaatctctcgcttatgtcagagattttcagcgcgccctcttctttcagccattcaagcaaggtttgctgtctgtgaatcggaagcaattctgcatcctcctttttatgcgaatgagtgatgaacctccctctaagagtagatgttttcacaaatgcacacaagagcctgatgataaaatatgtgaaaaaatgttgaacaatcacaaatgtaaaacacgcagtcagactctgttataatagaagagttgaatggaggaataaacatgaaagaaacgacctgcccaaactgcggcaagccgattacaggcgacatggtcagatcatcaatgatcccgtgccagtttcagtgcgggcattgccatgtgaaattgcgtgaatataaagtatcagctccgattatggctgcggccattgcgatcacggtgcttttgatttatcttgtgcagatggccagaaccgccgtcatgccgatgtttccggcagcgcggtatgtgccggccgccattttcgcgctcgtatgtgcgtatccggtgtttattgtcagtgagcggctcattgccaagctcgtcgtcacaaaaggacacattatatacagaaagcggtaagacacctttgatgaggtgtcttttttttgttaaggatttgtcacagtctctgtgccaaactcctctttacttttcattgaatggggattgtaagcgttttatgatgaagacacaggggagagagaaaccccgtgtcttatttattttcatctgaaggcaggcaaacagggagggaatgagcatgcagcaagaacagcaagctggcatgaaagtgaagatacagcggttcggcagttatttaagcggtatgatcatgccgaatatcggcgcatttatcgcatggggaattatcaccgcgctgtttattccggcgggatggtttccgaatccgcagctgaatacattggtaagcccgatgattacgtatcttctgccgcttttaatcgcatatacgggcggaaaaatgatctatgatcaccgcgggggagtcgtcggagcgacggccgccatcggagtcattgtcggagcggacattccgatgttcttaggggcaatgattatgggacctttgggcggttatctcattaaacaattagaccgtctgtttaaagataaagtcagacagggttttgaaatgctgatcaacaacttcacggcgggaattatcggcgcggtgctgacgattatcgcgttttatgcgatcggcccggtcgtcctgtctcttaacaagttgctggcggcgggtgtggaagtcattgttcacgcgaatttgctgccgattgcaagcgttttcgtagagccggcgaaagtcctgttcctgaataacgcgatcaaccacggcattttaagtccgatcggaatcgagcaggccgccaaagcgggaaaatccattctgttcttagtggaagcgaaccccggaccgggactcggtattttactggcctatatgttctttgggaaaggctcttcaagatcgacagctccgggagcggcgatcattcatttcttcggggggattcatgaaatctatttcccttacattttaatgaaaccgatgctgatcctcgcggcgatcgccgggggagcgagcggactgctcacattctcgatctttaacgctggtcttgtcgccgcatcatctccgggaagcatcatcgccattttggcgctgacgccgaaaggaagctatctcggcgtgctggcgggcgtcatcgtggctgcggccgtatcgtttatcgtctcggcgcttattctgaaatcgtctaaagcgggcgaagaagatttgacagccgcggcggaaaaaatgcaggaaatgaaaggcaggaaaagtgaagcggtggccgcattggcagacaaagaggaagagccggaaaacagcgccgctgatatttccgctgaccaagtcagccgcattatcttcgcatgtgacgcgggtatgggatcgagcgcaatgggcgcctccattttaagaaacaaagtgaaaaaagcagacctggatattgatgtgacaaatacgtcgatcaataatcttccgaatgacgcggatatcgtcattacgcataaggacctgactgaccgcgcgaaagcgaagctgccgcaggcggtgcacatttcggttgataatttcttaaacagcccgaaatacgatgaactgattgaaaagcttaaaaactaatcaaacagaaagagggatcttcatcatggaagtattggctaaagcgaacatcaaactgaaccagacagtgaactcaaaagaggatgccatccgcctggcgggacagacgttgattgataacggttacgtgaagaacggctatgtggaaaaaatgttcgaacgtgaagaaacatcatccacgtttatgggaaatttcattgcgatcccgcacggaacagaagatgcgaaggatgaggtgcttcattcaggcatttccgtcatccagattccgaacggtgtggaatatggtgaaggcaatacggcaaaggtcgttttcggtatcgccggaaaaaacaatgaacacttagacatcctgtcaaacatcgccatcatctgctcagaggaagaaaacatcgaacggctgatcagtgcaaagacggaagaagaactggccgctattttcagtgaggtgaactgacatgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacacctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcatacggctttaagcaatccgaacacgagcagtacatgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcgcggaaaaaggcacgagcggcgttcttcaagacatttgcggtattcagccgcatgaaccgctgcacggcatcgtgctcaaaaagctcaatcaataaaaatgaacccgcgtcggggggacgcgggttttttcttgcgttataatgagagggaagggaggctgcgtgatgaatcagaagctattgccccatcgttttccgtttcttttgattgacggcacgacgaacagtgaagccggaaaatgggcggctgcttacaaaaacatcagtgaaaatgactggtttataactgaatcccaaagagagatgccattttcgctcgtcgttgaagcaatggcccaaacggcggcttgcgcgggaattaccggcggtgacggtctcggtctcttatccgcggtgaagaaagcggaaaggttaggtgccgctttgccgggagaccgtctggatcttttttttgaggtcacgcgaatcagacgcggttttgtgttcggccgggcgaaagcgtccgttgccgggaagcctgtggcggaagcggagctcagcatatttatccagccatcgtaaaaaaagccgcctccaccggcggctttcggacaagcgtgttattttgtatcataatctctctcactttgtgaattgtccctctggtcatgtttgtgtttttcgtcattggcgttttccttcagctcttccagcggaatcggatccgttaaatcatgatgttcaggattttcattcggtttgttcttttgttttctttctttcatcctccatcacctcaatatttcttttcctcaacgctcgccccgccaaacgcaggaagcggttttttgttcctgtgggtcatatgtattaaaatagagacgactacaatataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcacaggacgcacgctgatgacctgccgcgaactggctgagtctctcgagctgtcatcctttttaatcacggcaaacggcagcgaaatctgggattccaactttgagctggttgagcgcaagcttcttcataccgatcatattcaaaaattatgggatctgaggaataagcacaacacgaatttctgggcctctaccgtcgatagagtgtggagaggggaattcccggaaacgattacggatcatcagtggctcaagttcgggttcgaaatcgaggatgatgaagtgcggaatgaggtgctgaaagagctcaaggaatacaaggagctcgaaatcacaaactcaagtccgatcaacatcgaagtcaatgccctcggtatcaacaaagcggctgcgctggcgaaggtatcggaaaaactcggcttcacgatggaaaatgtgatggccatgggtgacagtctgaatgacattgccatgatcgaaaaagcgggtgtcggcgtcgccatggggaacgcgcaggacatcgtgaaagaaacagctgactgggtgactgatgtcaacacggaaaacggggtcgccaaagcgatccgccactgggtgttataatagaaaaaagagagagtctcagcatgaggctctcttttttgttttgtcagatttgtgactaggtccatggtaggttttctgacaaaaggatgttcaaacttgtcagaattaaatataatgaagagaaatccaacaattcggaatagtcattccaaatatcggaatgataataaaataaaacgtttacaatacaggagggagcttatgtttcagattgacatcaattgtgatttaggagagagtttcggtgcttataaaatcggactggatgaagagattttggattatgtgacatctgcaaacatcgcctgcggctttcatgcgggtgatcctagcgtgatgcgcaaaacggttgcgcttgcggcggaaaaaggcgtgaaaatcggcgctcatcccgggctgttcgatctgcagggattcgggcggcggcagatcgcgattacgcccgaggaagcgtatgatctgacgctgtatcaaatcggcgcgctgtcagggtttttaaaagcggaaggtgtcgagatgcagcatgtgaagccgcacggcgctttatataatatggccgccgtcaatcccggcctgtcagaagccatcgctcaggcggtctgtcattttgatcccggacttattcttttcgggctttccggaagcgagctgattaaagcgggagatcgaatcggactgaggacggcaagcgaagtgtttgcggaccgcacctatcaggaagacggcacgctgacgccgcgttcagagccggatgcgctgattcaggatgacaaaaaagcggtcggtcaagtgattcaaatggtgaaagacagcacggtgacatcacgtaagggacaagctgtaaacctgaaagcggacacggtctgcattcacggagacggcgcccacgcgctgacattcgcaaaaacaatcaaaaaagaattaaaagcggcagacattcaaatcagcgcgcttgcaaaagactgagcagcagagggaggaagacagcatggagcaaaagaaaaaaacagccggaaaggcttccggcaaatggtcgcttcttttaggcgcgacatttttgatggcgacatcatcaatcgggcccggctttctgacgcaaacggccacgtttaccaatacattggcggcaagcttcggctttatcattttaatttctattattttggacatcttcgcgcaaaccaatgtatggcggattatcgcggtttccggaaagcgcggccaagagattgccaatatggtgcttccgggcgccggttatgccattgcttttctggtcgtgctcggcggacttgcgtttaatatcggaaacatcggcggcgcgggtctcggtcttcaagtattattcggaatcaaaccggagatcggcgctttaatcagcgcagcggtcgcggtgctgatttttgtcataaaggaagccggaaaagtcatggaccgttttatgcagatcgccggaatcgtcatgatcgtattgacggtgtatgttgccgtaacgacgggtccgccggtcggacacgccgttgtaaaaacttttatgcctgatcatatcagtgtgctggcaatcgtgacgcttgtcggcggcacggtcggcggatacattacatttgccggaggccatcgcttgcttgattcaggcatccaggggaaggaagtcattcctcaggtgacgaaaagctccgtcacaggcgtcttgattacatctgttatgcggattgccctgtttctcgccgtgctcggcgtcgtttcaaagggtctgcgcattgatcctgataatcccgcggcttctgtattccggcttgcggcgggaaatgtcggctataaaattttcggcgtcatcatgtggtctgccgctatcacgtctgtcatcggcgccgcctatacatcggtgtcattcttcaaatcgttttcggcaaaaatcgaaaagcactcacatggcgtaattatcggttttatcatcgtatccactcttatttttgtcacgatcggccagcctgccaaaattctggtcgcggtcggttcgcttaacggcttaattctgccgcttgcattagcgatgattctgttgggcgcctataagaaaaaaatcgtcggcgattacaagcatccgatctggctcacgattgcaggggcgatcgtagtggttgtcatggcggttatgggcatctatacattattctcgcaaatgccgcagctatggagctgatgatatgaaaaaccatatgagtgatatgagtcccgaagaagtcagacagcttatcaggaaagggcagatgaccgggccgacggcgggattggccgcttcttacgcacaagccaatctcgtcgttttgcaaaaggatcttgcctttgattttctcttattctgccagcgcaatcaaaagccttgtccggtgcttgatgtgacggatgcaggttcacccgttccggcaatagcggcgccgggagctgatatccggacggactttccgaaatacaggatttatcggcatggcgtgcttactgaagaggtaacggatattacgccgtattggaaggatgattatgtcgggtttttgatcggctgcagtttttcattcgagcaggcccttatcaatcagcacattccaatcaggcacatcgatgaaggcgtgaacgttcccatgtataaaacagacattgactgtattccggcgggcccgttttcaggaaaaatggtcgtcagcatgagaccgattccggaaaggctggcagtccgcgcggcgcaggtcacgtcacgttttcccgccgtgcacggcgcccccgtccgcatcggaaatccgcaaagcatcggcatcagcgatttgcatcagccggatttcggagatgccgtaacggtgcgggaaggtgaagttcccgtattctgggcttgcggcgttacaccccaggcggtgatcatggaagcaaagcctgatatcgtaataacacattcaccggggcacatgctgatcaccgatatacaaaatgaatcgcttactgtcctgtaagtgagaaagaatacaacgaggtgatgacaatgatgcagtatagcggaaatacagcgcttgatatacagccgtacggtgattccgccgttatcatccgctttggcgggcacatcagcgaagaggttaacagccgggtgcaggccgcggcagcctgtatggaagaacggccgtttccgggcttcgttgaatgtattccggcattcacaagcttaacggtcttttatgacgtgtctgccgtctcaaacataaaaaaaggcgtctctccttttgccctggtcaagaaagaagtgacagaacgtctcagccatataatgaccggccgcaaaaaagagcgccgggtgatggaaatccccgtttgctacggcggagatttcggtcccgatttagaagaggtcgctgaaatgaacgatctgaccccggaagacgtcatccgcattcatactgaaggcgaatatctcgtttatatgcttggatttgcgccgggatttccgtttttaggtggaatgtctgagcggatcagagcgccgagaaaggcgtcgccaaggccgtccatcccggccggttcagtaggaatcgcgggaatgcagaccggtgtgtatccgatatccactcccggcggctggcagctgatcggcagcaccccgctccggcttttcaggccggaagaacatccgccgagtctattgagagcgggtgatacggtgaaattcgtccggatcacagcagaggagtacagccgcatcaaggagggagccgaatgagtatgaaagtggtaaaacccggtctcttgacgacggttcaggacacggggcggacgggatatcagaaatacggtgtgctgggaagcggcgcaatggatacgatctctctgcgcatcgccaatcttcttgccggaaatcaagaaaaagaggcggggcttgaagttacgcttatggggccagggccttcctttgagttctcagaacccgcggttattgccgttacgggggcggatttcgcctttcatattaatggggagcccgcccctctgtggaaaccggttttgataaaggaaaacagcgtcgtttcattcgggccgtgcaagatggggagccgagcttatctcgccgtcgcggggggatttgacgtgcccgccgtcatggaaagcaaaagcacgtatgtcagagcggggatcggcggcttttgcggaagagcgctgcaaaaagatgatgagctgccgctcggccgtatgacgccatgttcggaatcaatcgcgtaccgtctgagcgattctttcggacagtatggtttctcagcgcctgattggtctgtcagcagcagaggggttctgccgctgaaaaaaaatccggtcatacgagtgcttgaaggcgctcaatttcacgcttttacagaagaagcaaaattacgtttttatcaagagtcatatacggtcacgcctcaatccgaccgaatgggctaccggctgaagggcgctccgcttgaattgcgggagccgctggaaatggtatctgaggctgtgacgttcggaacggtgcaggtgccgccggacggcaatccgattattctgctggctgacagacagacgacggggggctatccgcgaatggcgcatatcatatccgccgatcttcccctcgtcgcccaaacgatgccgggggaacatattacgttccgggccgtttcgctggaggaagcggaaatgctgcttttggagaaggaacagcagctgaaggagctgaaagcaaggctcaaaatggaatggctgatctgacaaaggggctaaagaccatggaaaacaaaaacaaaaccgtcatcaaatcaatggaactgcttcatttgtttctcactgaaccgagcctgagcttaaatgagctggtttctctatcggaaatgccgaagacttcggttcaccggatggcaagctcactggaggaaacagggtttctcacccgggcggcggacggccgttatcagcttggtctgatctttttacaattcggccagctcgtctctgaacgtctggatatcaggaaaatagccaaaccgattatggaagagctgtgcagcgaagtggatgaggccgttcagctgatcatgagggacggggatgaagccatttacgtcgaaaaaattgaaggcacccaaaccgtccgcctgtatacggcaatcggccgccggtcgccgctgtacgcgggagcgtgcgccagaagcattttatcgtttctgccggaagaggagattgacacatacattcagaagacaaagcttgccgcaatcgcctcaggcacgatgacggatcgggctgaactgcttcactccattgaaagatccttgcaatcaggttatacgatcagctattcggaattagaagattatacggcggcgatcggggcgccgattttcaatcacgaaggtaaggtggctgccggaatcagcatcgccggcttcgaagcccggttttcagaggacaggctgccgtatttaaccgaaaaggtcaaaaacgccgcacagcatatttctgagaaattaggttattgaccgagccaatttttcttcactcgcgtacattacaatatcgatagtaacgagtggaggaaagtaaatgggacttgtttatacggcgctgggggattctttgacgacggggaggggatccgggccgttttccgccggttttgtccagcggttcgggcgcatgatggcagaagatttacagacaagaaccgacgtatccatctttgccaaatcaggccttgagacgggagaaattctcgggcttatgtccttcccgtacattcagaggcggattcaggctgctgatatgattacgattacaggctgcggcaacgatttgatcgattcggttcaggcatatcagcaaacatcggacgcttcggtattcaccagcgtgtccagtcactgccatgagaactttgaaaagatgatagccaagattgctgccttaaaagggccgcacccgtctccttatgagatccgcgtcttcaatttatacaatcctttcccgggcatctccattgcagaaaaatggatatcctcttataatgcgcacctcagcacactcgcatcggcgccgcacgtcaaaattgccgacgtccacagcgctttcaaaggaaaaatgaatgaatatctttcttatgaccgcgtacaccccaacagcaaggggtatgaagtcatggcatgcgtcctgcgggggctcggatacggaagcctcgccagctcataaaccgcgcgctccttttcatggggagcgcgcttttcgtgctccttaaaacaaacttaaaattgtccgactttcgttctatccgcgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctctgtcatacagccggttatgctcgtgtttctcggtgcggtcatgttcattcaggggctggaggaaaaacggaaagaaaacgacggctccgggaaattcaatatctataccgccgtttttgtatggtcgatctccttaatcggttttacgcttcacgcgatctgagtctgatagatcctgaaaatgctccacaacgggaaatggtgaataaaaacggtgcagtaaggctttccactcctgatattccggcgatccgcgaaagccttttgtatgatcttctaatgtctcccattccacaagcagcaaatatttatgcgtcttttccatacatttggacaaggaatgggacagataacctttcatgcccgcgataatcggctccgcccggcggaatgcctcttcgaattccccctcaagaccttcttttacatacagcatggctgcttctctgatcatctgaaattcctcctttttttaatagatacattgtataaaaatatgggccgtgacggccggaaaaacaaaaaaattttaaacgctatgagaaaaaaatccttgccagcctgatttggtttaggagaaaataacagttggaaggcaggggaattgacagtgaaaaaagggttatacctattacttttactcgcaggaatcataggtttgatcggctgctcgaaaacggaatcggccgaagacagaatgaaagatttcgtaaaagactggaacggcggtcattacgataagatgtaccaaagcctcacccaggatgaaaagaaaaaacgatccaaaaaggattttgtaaaacgatatgaaaccatttatgaacaagcaggggtcaaaaatctgaaagtcactgccgaaaaacaggacgaagacgataagaaaaaagatgacctccagcacatcgattataaagtcagcatggatacaaaagcagggaaggtcgcttttgaaaacacggccgtcctgaaaaaagagaaaacagacgatggagaatcatggaacattgactggaatccttcttttattttcaaacagctttccgatgacaaaaccgtgcagatcgcaaatgaggaaccgaagcgcggacaaatttacgacaaagacggaaaaggtctcgccgtgaataccgaggtgccggaaatcggcattatccctggaaaactcggcaaggataaagacagcgtgatccaaaaactgtctgaaaaactggacctttctgaagacgatatcaaaagcaaactgaaccagggctgggtaaaagacgactcctatgtcccgattcaaaaaatcagaccggatgatgaaagcaaggtcaaaagcctgcttgcattagacggcgtgacgaaaacgaaagtcagctcccgctactatccgtacggcgaaaaaacggcccatctgaccggctatattaaaaccatcacagcggagcagctgaaaaaagcgaaagacggccaatacagcgatacttccaaaatcggcatcgccggccttgagaatgtatatgaagacaagctgcgcggcaagaccggctggaaaatttacgtcccgcaaacaggtgaggtcattgctgaaaagaaagccgaaagcgggcaggatattcatgtaacgattgacatgaaaacgcagacgaagctgtatgattctatgaaagatgacagcggagcggcagtcgccctcgaaccgcaaacgggagagacactcgcgctcgtcagcgcaccgtcttatgacccgaacggctttcttttcggctggagcggaaaagagtggaaaaagctgaatgaagataaaaacaatccgttttcagcgaaattcaacaaactttatgcgccgggatcaacgattaaaccgattgccgcggcagtcggcctgacaaacggcacattgaaagcatcggaaaagaaaaaaatcaccggaaaagagtggcagaaagattcgagctggggcggttaccatgtcacacgcgtatcagagcgcctgaatgaagtggatctcgaaaacgcgctgatcacatcggacaacatctactttgcgcaaaatgccatagatgccggagcggacgcgtttacaaaaggattaaaaacatttggctttgatgaagagattccgtaccaatttccgattgaaaagtcctcaatcgctaacggcaagcttgattccgagatccttctcggagatacgggctacggccaggggcagatgctgatgtctccgctgcacttagcggctgactataccgcatttgtaacagacggaaatctcgtcaaaccgacattgatcaaagacggagaaaaaacaccgcaaatctggcataagcaagtggtgtcgaaagccaatgccgaagaaatcacgaaagggctgagaggcgtcgttgaagatccgcgcggctctgcatatcagccggccgtaagcggcattaccgtagccggaaaaaccggtacagccgagctgaaaacgtctaaagaagataaagacggcaaagaaaacggctggtttgtcggttacgattataaaaagaaagacctcttgattgcgatgatgattcaagacgtcaaaaaacgcggcggaagccattacgtcgttgaaaaagcgaaaaagcagtttcagaatcattaaatgacgatttttgcgggctgaaaggaaaatcggccgccgaagcagaatgaaacagcatgggcaattcctgaaaacagagatacaagaggctctaagaaaaagggggatttcacatgcagcgcattcaattggctgaagacctggaattttcaagagtgatacacgggctttggcgtctgaacgaatggaatgtttcagacggagagctgctgaatctgattgaatggtgtatcagccaaggcatcaccaccttcgatcatgccgatatatacggcggttatacgtgtgaaaagctgttcggcggcgctttgtccctttctccttcaataagggagcgaatcgaaatcgtcacaaaatgcgggattgtcattgaatcaccggagcggccaggaaacaagtcgcatcattataatacgtcgaagtctcacatcttagcgtcggcggagcagtcgcttttgaatctgaatacggattatctggatgtgctgctcattcacagaccggacccgcttatggatccggaggctgtggctgaagcgtttcacgcgctgaaaagctcgggcaaggtcagatatttcggggtatcgaactttaaagcgcaccagtacagaatgctcgaatcctatttggatgatccgctcatcacaaaccaaattgaaatctcggcgtacaagctggaaaatattcatgacggcacgctggatttctgtctggaaaaacgcattccgccgatggcgtggtcaccgcttgcgggcgggagcgtctttacaggacaatcagataaggccctccgaatccgtgccgcgcttcgttccgtacaggaagaaatcggcgccgcttccattgacgaagtcatgtacgcatggctgttcacccacccggcagacatcatgccgattgtcggcagcggaaaagagaaccgcatttccgccgcggtgcgtgcatccgcgtacaaactcagccatgatcagtggttcaggatttataccggtgtccaaggctgcgatattccataaacagaacaaacgcccggaaggtatcttccgggcgtttgtttatgtggtgtgcaatgtctaaaaacaagtaaggtcactttgaagtatagccgtgcggatcaagagtaacaagcgtcatggcatattatctgacacatttttctttttcaatactgtcacacggtccagtgccaaattgccatttgaaaatggttgaataatcattgaaagcgttttatattataatttacaccactttccccggcagcactccccatatgccatacttctcacaactagaaaatctggaggcgcgtttcatgtatatgacagcgagagaacaaaaattaatgaaacatctattactgcagaaccgttacgagacagtgcatgaactggcagaagctttacaagtcagcacaagaaccgttcaccgcgagttaaaaacaatcaaaccgatgatggaatcattcggtctggcacttgataaacagcccggcaaaggactgaaagcggtaggaaacccggaggacaaacaaaaactcctgtcagacctgtcctatgaacagcatgaatacagcgctgaggagcggaaacttttaattctatgttcactattagagtcgcaagagccgatcaagctctacagtctggcgaacgaattgcaagtgacaaacgcgacaatcagttatgatctggatgagctggagacctggatcgcgcccttcggcttgacgctgatccgaaaaaggggcttcggcatacagctgacgggtccggaaaatgcgaaacggaaaatcgtcggcaatctcatcgtcaaccggcttgatattcagagctttttggaagcggttgaattcaatattaaaggaaaacctgacgatgctgaaaaaatgttcggggtcgtaaataaagcggaacttttgaaaatggaccggctcttgattcagctcaaggaaaaaatcgcgatcgccttatctgacagctcatacatggcgcttgcggttcatttaacctttgcgatggaccgaatcagactcggagaaaccatcacgatggaggcttcggaactaaaagcgctgcagcagacgaaggagtacggctctgcgatggaaatggcaaaagagcttgaaaaagcgtttggcgtttcaattccggaagctgagatcggttatatcaccattcatttgcggagcgccaaccgccaatacaaaacggaattcaaaccggaaaacattgaagttgaaacggccttgcaaacgaagcagctgatcggcttcatttctgaaaaaatcaaaattgatctgacggaaaacggttctttatacgacggtttaatcgcccatctggagcctgcgatcaaccgggtgaaagaaaatatcgacatgtacaacccgatgaccgagcaaattaaacgcgactactttctgctgtacatggccgtagaagaaggaatggaaaaattctttccggggcttcttttctctgatgatgagatcgctttcatcgttcttcacttcggctccgctctggaaatcaaacgggaagaagcgaagatcaaagcgctgatcgtctgttccagcggcatcgggtcgtccaaaatgctcgcatccagactgaaaaaggagcttccggaaatccgttcctttgatatgtcttccctcatcgaactgaaggaccgagacatcaccgcgtatgacatgatcgtatccaccgttccgatcccgtatggaaacattgattacgtcatggtcagtccgcttttaaacgaagaagacgctgatcaggtgaagcagtacatcaaaagaaaaattccgctgattcttgacaaaaaaagaaacggtaaaagagaagagaagcagccggagacgcctgatatgctggaagcggccggccgtatggcacattatgcggcggttatccaaagcgtgctgcggaacttttcgatcaaatccattgagtcaaacacggcgtacgaactgtttttgaatcgtttgtttgccatgcttgagcaagaaggatttgtccgtaatgccaaacaaaccgcacagcgccttgcagagcgtgaacgacagggcggactcggcattccgggaacggcgatggcgctgtaccatctcaaaaatgaagaaattgtcacgccttttttcaaaatttatgatttgacagctccatgcagtgtcaaaggcatggacggaaattccctgaccgtcggccgcgctttggtgatgatggcgccggctgatatgcccgctgaagggtcggaaatactaagtgcggtcagctccgccatcatcgagtccgaagacagtataaaagccttccagacggaggatgaagccgatttatacaaacgtttaaacaagctgttttatcatttcattcaggagaaaggacagcggtaaacagaaagcgcacacctcatatggggtgtgtttttttctgcatgtatgagggtaaggggaagggaagaaactaaaaacatgggactattgtatcattcacgaatggaatagttctaaaacaaaattgttttacaagttatattttttggtttaaaatgggttgcgtgaggaagaaaatctgacagagttttttgtgatttatgattatgggagatgaaaatatggagacattacagcatatgattctgcatgacatttcaaatagcgaagagatcgaagctgtaaaaagcggtgcgcataccctgacctacgcggaatatcgaaaacgaatcaaccagcttgcacaagcgcttcttgataaaggaataaaaaaaggcgacagagtggcgatgctttgcaaaaacggccacgcgtcatccattgtcatgtttgcggcactcgaaatcggcgcggttgttgtgccggtcagctggcaattaacaccttacgaaatgaaaggcattttagcagcctgtgaaccgaaagctgtctttttcggcactgaatttaaagagattatggaagaagttcttcctgcgctggtatcttctcttaaactgaagatcgagacaggaacagctgcggagacaacgcctgagtttgacgctttattgacaggctccggtgatacaccggatgtcgaaacggtgtctgaaaacgatacggcattgctgatgtttacctcaggtacaaccggcaatccgaaacgctgcatgatcactcacggcggcatatacaactacgtaaacgcgacattggcttacacggggagaatgcagcatgtccgcttcttagcatgccatccgaattaccatacgagcgcgattatctgccagatggtcggcacgatgagcggaacgacattcattatgacagacaatcaggaccctgtggaaaacttgaagctcatcgaaaaagaaaaaattcaaaccatcatggcgctgccagtctatttcacatacctgctgaaagcatgggaaacgcaccagactgacatgtcttctatcgtttatatgatgacgggaggcacaaaggtgccaagcagcctgatccagcagtatctcgacatcggcatcccgctcatgcacggatacggaagtacggaagcgtggggcatcagctcttggaatccgcaaatgggaatggataaagccgcttccgcgggtaaaccgatggaagaagtggacgtccgcgttgtagatccggaaacaggtgaagtccttccgcaaggctcaattggagaagtcgttgtgacaagtccgtttttattcaaaggctacgaaggtaacgaagaagcgacacgaaaagtgctgaaagacggctggttccataccggcgattccggctatgtggatgaagacggatttatctttatcaccggacgttataaagatgtcatcatctacggcggcgataatatttatcctgaccagattgaagaagtcattcagcaagtgccgggaattctcgaaacagcggttgtcggtatccctgatccgctctacggcgaaaagccgaaagcgttcatcgtgacaaacggcagagaagacctgacagaagaagaagtgacccgattccttcaagaacgtcttgctgcctttaaaattccggacattgagttcgtcagcgaacttccgaaaaacaaccttggaaaagtgagaaaagacgtgctccgcaaacaagcggtacgttcataatagagaacaaaaacccggctgccagccgggtttttttcttgcgttccatgtgaaacatttttctccgaaaacgttttgaactgtctcaatcatgtttatccggaagacagcagaggtagacaagaaatatgacaacgaaccagaaggaggaacttgacatggaaaactatccgaaggaattcccggcggaatcacaaaaccgccagccgggcattgaaagcgaaatgaatccggcgcctgtttacgaatacaaagaatataaaggcgctgacaaattaaaagggaaaaccgcgctcatcacagggggcgacagcggtatcggacgcgccgttgcggttgcttacgcgaaggaaggcgcaaatgtcgcgatcgtctattttgatgaacacgatgatgcggaagatacaaaaaaacgagtggaagaagaaggcgtaaaatgtctgttaatccccggcgatgtcggtgaggaagacttttgcaatgaagccgttgaaaaaacggttgaagaattcgggcgtcttgatattctcgtgaataacgccgcggaacagcatccgaaagaaagcattaaagacatcacaagcgagcagcttcacagaacctttaagacaaacttttactcacaattttatttgactaaaaaagcgattgattacatgaagccgggcagcgcgatcatcaatacgacatccattaatccttacacaggcaacccgcagctgattgactacacggctacgaaaggcgcgattaacggttttacgagatccatggcgcaagcgctcgtcaacgatggtatccgtgtcaacgccgtggcgccggggccgatctggacaccgcttattccggcgacattctcagaagaaacagtcgcttccttcggtcaggatacgccgatgggccgggcaggccagcctgttgagcatgtcggctgctatgtgctcttggcctcagacgaatcctcttatatgaccggacagacgctgcatgtcaacggcggcagatttgtgaccacataaggaggctgaccgatgacgatatcgaaacatgacgtgaatgcatactatcaaaaagcgggaatcgttctgaatgatgatgaagtcgaagacattcaaatcatggattacggcttaggcaagcttgaggaaaccgggcttcagctgtttatttacgtgaataccgaccgctactgttcgaaagaattggtactcttcccgcgccagacgtgtccggaacaccgccatccgccggtcggcggcgagaagggaaaacaagagacattccgctgccgctgggggaaggtgtatctctacgtggaaggcgaaaagacagagaacccaagcgtcctcccgccggaagaagacaaggaatactacaccgtctggcatgagattgtgcttgagccgggcggacaatacaccattccgccggatacgaagcattggtttcaagcgggagaagaaggggcggtcgttacggaaatgtcatcgacaagcacggatgatcacgatgttttcaccgacccgcgcatttaaggatgaggctgcacgcctcatcttttttgtatggaaaaaaataaatttacctgtataatggctaataaaggaaagaaggtgcggtcgtgttttcctgtcaaatccgggaacatctgacgatcagattgcttgccaaagaagatacggacgaattgtattctgttatgaagcgaaatcaaaaccatctcagcgaatggctcagctgggcggaagaactggctgacattgatacgtaccgcgatgtgatcatccccgaatggcgctataaatatgcggaagagaatgggtttgacgccggaatttttgtgaagggtcggttttgcggcatgatcagcatccataatgtcgatacagtcaatcaaaaagcagagatcggctactggctggatcgagagcatgaaggattcggcattatcaccgcaagctgccgggcggtcatcacccatgcatttcaggacctcgggctgaaccgcatcatgatcagcgcggctgaaaaaaacacgaaaagcagggcggtggcggaacggctcggatttcagaaagaaggactgacgagagaaggcatttttgtacagggcgcctatcatgacacggtgaactacagcatgctgaagcgggaatggagcgaagatcggcagaagagcacatttcttggtttaaatgtctccccaatgtggaaaagtaacagcggagacgttaaaaaggagtgattcttcatgaatcaaaatgaaatcaaagaaaaagtgcttgaagtactggatcatcataaagtcggttcgcttgcgacggtagagcaaggcaaaccgcattcacgctacatgacatttttccatgacggcttaacgatttacacgccgacgagcaaagacactcataaagcggaagaaattgaaaacaatccgaatgttcatattctgttagggtatgactgtgaaggattcggtgacgcttatgtggaagtggccggaaccgccaaactgaacaactcagcagatttaaaagaaaagctgtgggatccgaaactggaacgctggtttgacggaaaagacgatccgaacctggtgattctcgaaattgaaccgaagcagatcaagctcatgaatgcgggtgaaaaaacgccggccgagctggaactttaataaatcatttgattattcaggggcaatctgttatacttaactgctaagtgacaacatgcaaataaaaaagaaagtaaacttcttttttctgttttgatatagaagcttcaggcttcaacggacagcttgaaaaaaagctgagcttattcttttccttctgatattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgttaatacgaatcacccgcaggctaaggcgggcaaccatatattatttatttgcgtaagaaaagaataagacaaaaccgcgccggacatccgggcggtttttttatgtaaacggccgaaaccttgccgcagtctgcagagtctaatcagtatgaaaagatttggaggaatcatacattgcacgttattacttcacaagtactgtttatcttctgttttctgctgctgatacattcgattgaaacgcttgcctatgcaacacggctttccggcgcgagagtcggatttatcgcgtccgcgctgtcattatttaatgtcatggttattgtgtcgcgcatgtcaaacatggttcagcagccgtttaccggacatctgattgatgccgccggatcaaacgctctgtctgttgtgggcgctcagtttcgatttttaatattcggctccacggtcggaacgatgctcggcatctgtcttttgccgacattcgtcgcgttattctccagggcgattatacacttggcggacggaggaggctccgtcatgcaggtatttaaaaaaggattttcactgaacgggctgaagcatgcgcgttcttatatcagactgccgtcagtctcctatttaaaggggcttcaattccgaatgatcccgaaacgcttgtttgtcattaatatggtcattacgtctatttacacgatcggtgttctgtccgctctgtacgccggccttctggcgcctgagcacagcacgaccgccgtgatggcatcaggcttaatcaacggcgttgcgactatgctgctggccgtgtttgttgacccgaaagtctccgtactggcagacgatgtggcgaagggcaagcgcagctacgtctccttaaaatggacctcattgacgatggtcacatcaagggtcgcgggcacgcttctcgcccagctcgtattcatccccggcgcttattatatcgcctgggtgacgaaatggatgtaacgcatgaaaaaagctcctctgcagaagaggagcttttttattgataatttctcaggccgcgatcataaataaaattaccgaacggaataaaggccgcgataaaaccggcggctgaccatttcacatgccatttgacagtaaacgccgcatacgccagcaccgcaagataaatgataaacaaaccgccgtgaatggaaccggcaatggtgacggcgagcggatgatgagcccaatacttcagcggcatcgcgataaacagcagcaccaaaagcgacattccttcaataaaccccatcgtgcgaagtctgccgatcggcgtgtgtaacatacagctccctcctgtcggacatcttttttcctctatactataagcaaagggcagtcctaatatgaccatttcgcgtcagttcctgaaaaaaccttcatgatttcagcctgttgttcttgtcatttttcggatttctcttgataatatagccaaaagggtaaggaaggactacagtcatgaaactagataatgtggatctgagcatcattaaagagctgcagcgggacagccgcctgtccatgcgggagctgggcagaaaaatcaaattgtcagccccgtccgtcacagagcgtgtcagacagcttgagtccttcggcgttattaagcgctatacattggacattgatcaaaaaaagatcgggctccccgtctcctgcattgtcgaagcgacggtgaaaaacggaaaatacgatcaattcaaaacctacattcaatccattcccaacattgaattttgttttcgggtcgccggggcggcgtgttatatgctgaagattaacgcggacagtctggaaacgatcgaacacttcatcaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaagcatgtcaaaaacagttgtattagctgaaaaaccttcagtcggccgggacttggcccgtgttctgaagtgtcataaaaaaggaaacggatatcttgaaggcgaccgctacatcgtcacatgggcgctcgggcatctggtaacgctcgctgaccctgaaggatacggcaaagaatttcaatcatggcggcttgaggatctgccgattattccggagcctttaaagctcgtcgtcattaaaaaaacaggaaaacagttcaatgcggtcaaagctcagcttgtccggaaagacgtcagccagatcgtaatcgctacagacgcaggacgggaaggggaacttgtggcccgctggattatcgaaaaggcaaacgtccgcaaaccgattaagcggctgtggatttcctctgtgacggataaggcgattaaagaaggatttcaaaagctccgcagcggcaaagagtacgaaaacctgtatcattccgctgttgccagagcggaagcggattggatcgtcggcatcaacgcgacccgcgccctgaccacgaaatttaacgcgcagctgtcatgcggacgcgtccagactccgacactggcgatgatcgccaaacgcgaagcggatattcaggcgttcaaacccgttccttattacggtctccgcgcggcggctgatcagatgacgctgacatggcaggataaaaaaacaaaacagacaagaacgttcgatcagacggtgaccggccgtttggcaaaagacctgcaaggaaagccggcagtcatttcagaattgaaaaaaacggcgaaaaaaagcttcgctcccggtctttacgacttgacggaattgcagcgggacgctcataagcgcttcggtttctccgcaaaagagacgctgtccgtgcttcaaaagctgtatgaacagcataagcttgtcacttacccgcggacggattccagattcctttccgcagacatcgtgccgactttaaaagaccgtttaaacggtatggaagttaagccgtacgcccagtacgtcaatcaaatactgaagcggggcgtcaaagcgcataaaggattcgtcaatgatgcgaaagtatcggatcaccatgccatcattccgacagaggagccgctgatcctttcaagcctcagcgacaaagaacgaaagctttacgatctgattgccaaacgttttctcgccgtgttaatgccggcgttcgaatacgaagaaacaaaggtcacagccgatatcggcggcgaaacatttaccgcaaaagggaaaacggttcaatcgcctggctggaaagccgtgtatgatatgtacgaggatgacgacgatcatgaggaagacaaagaccagacgctcccggatcttcatcagggtcagcgcctcactgtctcatcattgaaagaaacgagcggacagacgaaaccgccggcgtgctttaatgagggcacgctgttatccgcgatggagaacccaagcgcctttatgcagggagaagagaagaaccttgtgaaaacattgggtgaaaccggcggactcggaacagtcgccacccgcgctgatatcattgaaaaactgttcaacagtttcttgatcgagaaaaaagaaaaagatattttcattacgtcaaaagggaagcagctcttacagctcgtcccggaagatttaaaatcgccggccttaaccgctgagtgggagcaaaagctctccgccatcgcagcgggcaaactgaaatccgccgtgttcattaaagacatgaaaacatatgcgggcaaaacggtgaaggaaatcaaaaacagcagccagactttcagacatgacaacatttcaggcaccgcctgccctgattgcggcaaaatgatgcttaaagtcaacggcaaacgcggcacgatgctcgtatgtcaggatcgtgagtgcggcagccggaaaacgctggcaagaaaaacaaacgcccgctgtccgaactgtcataagaaaatggagcttcgcggccagggcgaaggccaaaccttcgcatgtgtatgcggccaccgggagaaactgtccgtctttgaaaagcgcaaggcgaaagataaatccggacgcgcatccaagcgggacatcaactcttatatgaaaagccaaaacaaagaggagccgatgaacaacgcgctggcagaacagctgaaaaaactcggcctggataaatagatcagagaaaggcagcatttgtaaataaatgctgccttttgttgtgttttttactgtaatgggaataagatccatgtgaagagggaaaaggtgagaggcggcgcttccatttaaaattttccaatgtgaaaaaatgctagtattcttttatcgtttcctttatagtaaaaatactttgtgaaaaaataagatatgggtctaaaaaaggatttgtaaaataggaggatggactgtgaagcgattcgtttttcgtctgatgatccttttgatttcgatcgttctgacggcggggtgcgcggaggccggccctgaaaaacagacggcggccgaaccgtccggaccgcttcagcccgcagagcattttatttatcataaattgatgaacgggcgggggatgatccggacgaacatatccggtgagccggaatatttatctgagtctctcggactatggatggcatttttgctgaacaggaaagatgaacggcagtttcaagcgcaatatcagcttctcaccgattcgtttctgacgaaaaacgggctcgtgtcgtggaagattgacgggaataaagcgagcggcaccaatgccttaattgacgatttcagaatcatgaactgtctgaatgaggccggaaccctgtggggaaacagtgaatacgggaaaacagcggtgcagatcgggaaggcgctggaaaaatacaatacaaatgacgggtattttacggattattatgatgccgcttcaaatgccgcatcaaagaccgtgaccttgtcctatgttgaccccggcgccttacagatgctcagagaaaaagggattatcgatgagaaaacggaaaaccggaaccttgatgttctcaatcttgctcccctgaaaaatggttttctgccgaaatcattcaataccgaaacaaaggaatacaaatatgacagcgaagtgaatgtcatcgaccagctgtacgccgccgtgaatctgaagcggggcgatggcaaggctgccgcgctgtcaaaatggatgatagaggaatttaagtcgcgcggacagctgtacggacgatacagcgcagacacgaaggagccggcggttcagtacgaatcaccgtccgtttacgccctggccgttctttttttagcagaacaaaaagctgatccggctgtcatcaagccgctttatgaaagaatgacttcatttgaaacactggacacgctgaaacccgattacggcggctatatgagcgggagcgatacacattctttcgataacctgctgccgcttctggctgaaaggaaattgtttaatgaaaatatcattcaatgaatcacaaaaactgtgcagctacacagcagttatgctggtgctgctgtctttttttatttactatgcgtctcagcaatccgcagggcttctgataacctgcatcacattgcttgttgcgggagccggtatatggttcggggcaatctactcgctcgtcatgaccttactcgtcttatttgttctcggcagcctgctcctgtggtttcagaccgggagctttatggcgtctgccgatgccgaaagtctgcaggtgctggtcatttgggggattgcgctgctgctcttttcttacatagcgggaaggattcacgagttggcgaaggggcttgaacgctcagtgaaacagctgcgtgaagagattacgagctttgtcgccgtcgacagggtgaccggctttgacaaccatctgcggatgaagctggagctttctgaggaaatcaagcgggcggaacgctacggcaattccttcgtctttttgctgctgcacatgcattatttcaaggaattcaaatccctgtacggagaaaaagagaccgatcggctgctggcgtttatcagccgccaaatccggtcaagcgttcgggaaacagacaaaaaattcaggccgtccgccgaacggttcggcatcgtgctgacccatacgcctgaagaaaacatgccggccgttctggcgaagctgaaaaaggaattggatacgtaccggctgcaaaacggtaaatacgtctccatcaccttccgtgtatgttacttggcgtaccgaaaggatttacaaacggccgagcaatttttaaatgaactggaaaacgagatgatgatgaatgaactctaaatggatacgtcttttactctcggcgcttttcatgatttcggcggtttatgttccccgtccggcggaagcaaaagacaaaaaggacggcattctcattatttatacaagcacggacggcaaagaaaccgctgaggtcaaaatgcttgatctgaccgcgggccatttctcatccgccgtcaccgtgaaaagcgacggagacatcacagccgcggacttcaaaaagaatcggcgcgtcatctattacggcgtcacgaaaaaaaagctcagcacatcatttgtgtcactgatcagcagcatgccgcagcagcttatcagcatcggctataacgccggacagttccgccaatttgcggggttgtccctgacagaaaaagaaacggtataccgcatttacggcaaaaaagaaaaaacagacatgccgcttgaaaaagggatgtccgtgctcggcgtatcgggagtaaaaggaaagtccctttatacataccggtccggtgacggcagcacccgcccttttatgtggaaaacggcgcgctctgactattatttcggtgtgacgagcctgttaaatgattcgtttctgacggcgaaatcgctgcgcagcgcattcggagaatcacagggcggcaccctcctttatttgcggcttgaagacatcagtccgatgtcagatgaaacattgctttacgaagcgggcgcttatctgcataaaagacacattccgtttattctggcggtcattccggtctatctcaatccggaaaacggagaaaaagtatacctggcggacaagccgaaaatggtccgcgtcctgaaaaaacttcagcaaatgggcggaagcatcattattcacggctacacgcacgcttaccgatacagcgaaacgggagaaggctttgaattttgggatgccaaagcggatcagccgattacgtcagaaaatgcggatgatactccggtcaagcttgaaaaggaacaggattttccgaatgaaaaagcgtaccgggcgtatgtgaagcctttccgtgaaaaagaaaacatctacacgagaacgaagctggagcaggcgattgacgatctgacagagctcggcctttacccgctgtcattcgaagcgccgcactacacgatgtctgaagaaggctacaaaatcgcatcttcttatttctccagcattttcggacaagtgcagctcagcggcgcgacgtggaaaacctcgggcgcccctccgttcgtctcaaagccggctatgctggacgggatgacgctgtaccctgaaacaatcggttatgccgataactcaaaggaaaatccgctcggagatatggagaatcatatttctcagatgattgatttcggcggcggaacggcgggcggtttctaccatccgtatctcggcatgaaataccttcccgagctcgtcaatcagatggagcggattcccggcggcgagtggctcgatctgaagaaaacgaagcaaacggtaacgtcggacagcgtcaggatcaaaacggacggagacggaaccattcatgtggaaaacaagattcatccggtaacggcctttttcaatcatcaccagcagacgcctcttgaaaaagcgctttggattctctccggcgtggtgttattgtttatcatcatgttcgcctgctacgtcctttatttgcgcgccacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattccgaaatggcgcgcaaagatgggggagctcccgaaggtcagcgtgctcatccccgcgcataacgaggaggtcgtgatcaggcagacgctgaaggcgatggtgaacctgtattatccgaaagacaggcttgagatcattgtcgttaatgataattcctccgaccggacgggagacatcgtcaatgaattttcccgtcagtatgacttcattaaaatggtcatcacaaagcccccgaacgctggaaaaggaaaatcttcggcgctgaactcagggttcgcggaatcgaacggagacgtgatctgcgtgtatgatgcggacaatacgccggaaaaaatggcggtgtactacctggttctcggtctgatgaatgatgagaaagcgggagcagttgtcgggaaattccgtgttatcaatgcggcgaaaacgatcctgacgaagtttatcaatattgaaaccatctgttttcagtggatggcgcagggcggcagatggaaatggttcaaaatcgccaccatcccgggaacgaacttcgcgatcaggcggagcattatcgaacagctcggcggctgggatgataaggcgctggcggaggataccgagctgaccatccgcgtgtataatctcggctatcatatccgctttttcccggcggctgtgacatgggagcaggagcctgagacatggaaggtctggtggcgtcagcggacaagatgggcgcgcggcaaccagtacgtcgttcttaagtttttatcccaatttttcaagctgaaacgcaagcggatcatcttcgatctgttttatttcttttttacgtattttttgtttttcttcggtgtgatcatgtcaaacacgatttttatcatcaatcttttttacgacctgcacctgacagtcgggtttttggcgatgattttgtggatactggcctttttcctgtttatgactgaggtcatgattactttgagcattgaaaaaacagaaatgaacaaacaaaacttctttatcgtatttctgatgtactttacatactcccaggcttggatcgtgctcgtcatctggtcattattcacagagatcaagcaccgcttgttcaagcaggaagtcaagtggtacaaaacggagcgatacaatcaaaataaaagcgggtgacctttttgaaaaaagcgatattgataactggccttttgctattgatgtataacgggcaggcggccgcggcccgggagctgaaaacggacggttccgctctcggaacaagcgccggcgcaaaagagcagcaggcgctgactggcgatctgatgacactgtacggggcgaaagacagctcagagctgacctatcagattcctgcgggagcttcgaatgccgatcagtcgcttctgattgattacgaggcgtcaaacttattaattgccccgtcttctttaaccatcgccattgatgatgaacccgtcaaatccataaagcttgacggcagctccaagcggaaaacggtgaagctcaatctcagcaaaagccaatccgcccaaggctatcacaatgtatcattacgattttacggcgtattaaaagagggcgtctgcgtcaggcaggatacgtcaggcaactggataaaaatttatccggacagccgccttgtgctttcagaagcaagcaagtcaaagggagcggatctcggccatttcccgtatccgtttgcccaatcaggcaatacgggtgaagaaaccgatattatccttcctgacaaaccgacctcggcggaagctgaagccgcagtcaaaacagaaggatttctgaaaacggcagacagcaggctgaaggtatcctatgtaaaagaatccgatgccggcaaaatcagcaatccgtcaattgtcatcggcgctgatcagcattggaacgggaaaataaaagagcttttcgaacgggggaacttcaaagcggaagacaacaaacttcttctcgccgaacgggttctgacatcaggggacaaacggcagcccgtcctgtttgtcacggcgcactcagacaaaacgctggcggataaaatccgcgtcatcacagacagcgcttattcaagccagctgggcggagatactttgacaatcggccgccttcagcccgctgcggaaaagacaggcaataaactgacattagaggacttcggcgcgggaaatgtaacggtcggatcaaacaaaacggcgtcagagcacttcttttaccctgcggcggccgctgttgataaagacggtaaggtcaagctttcacttacattaaagacgtcggaatcgatccggacgaaggcggattcagatgatgacgccgagagagcggagctgaacgtcatggtcaacggacagccgaatgcggtgcgtcttgatgatctcggcaatcaagataaagatggcttttaccacgtctcaatcccgattgatccgaagcttttgcgaagcagcaggtacattgatctgcaatttgtcacatcaggtttgaaacataacaacccgtgtatcgaccgtgacgaaaataaatgggtctatattgataaaagcagcatgctgacgtatccggtaagtgatgcggcgcagaaagcggatttcgggcaatggccgctcccgtttgcgggcggcgtgaaagagaaaacagtgatcgtcatcccggataatgtaaacatacagacactgaaagaactttctctggtggcggattcattcggaaacggctttaccgtaaagacggcatcagacatgaaggaagcggatgccaaaggccggaatgttgtatttatcggaggcctgccgcaaattccgcttttgaaatcaaacgcctctaagcttctcgtgccgtcagaccgcagcggcgcgtacgatgtttcttcgtttcagatgctgaatgagacaacgaaacaagtcgcgtttacccaggaatcaccttgggactccggccgaagcatcgctgtttttgctccgttatcaggcagcggcgcgtctgtcacaaaagagctgatcagctttttagacagcacaagcgatgccgcaaccgtcgtcaacgaaacggccggcaagcagctgttttcaaaccatcagcaaatcaaatccgacgacagcagtccatcgcctgatacgaaaagccgttccgcagcactgaacgtcacgtatatcgctgttttcgcggcgcttataattattgcggccggtctgatctggctgacggcaagaagggaaaaaagaaaagcggacaatgaaaaaagtgaagagtaatgaaggaaaaagaggccgttaacaggcctctttttttgtatttttatttccatttttggcggtgatttttttatttttgaaacagcataaaagcccctttacaactgaacgggacgggagtatgatctcttttataatctatatcgcttaatctgtaatcagagcgggggaaccaatttgcggcgcgtcatgccgcttggggtgaatcctttttcaggtagggccaactctcatcagcccgaatccgacagctaacctcgtaagcgttcatgagaggagatgaatgaaacctgtgcacgattatggcgcaggggcatccgtttgcctctgtgtctttttgctgtgccgaaatatggcatgcaatcgttattcagagacatcatagcagtaagggtttgtaaatcaaacggaaaatgaaaaaaaggggaagacaaaaaatgtaccattcaatcaaaagatttttgattgggaaaccgctgaaatcacaggcggccggagagcagaaactcacgaaactcaaggcgctcgccatgctttcttcagacgcgctgtcatcagttgcttacggaacggaacagattctgatcattttggctgcggtaagcgcggccgcgttttggtattccattccgatcgcagcgggtgttctcattttgctgcttgctttgattctgtcctacagacagattatttacgcttatccgcaaggcgggggcgcttatatggtgtcaaaagaaaaccttggtgagaagccgggcctgattgcggggggctcattgcttgttgattatattctgactgttgcggtaagcatttctgccggaactgatgcgattacatcggcatttccggctttgcacccgtatcatttgctcattgctgttttgcttgtgattctgattatgattttaaatttgagagggctgtcagagtcggcgtccattttggcgtatcccgtctatctgtttgtggcggcgcttgtccttttgatcgtcgtcggactgtttaagctcatgacggggcaggttcatccggccgagcatacaccgatcggcacgcccgtagcgggcatcacgctgtttttgctgctgaaggccttttcatccggctgctcggcactgaccggtgtggaagccatttcaaacgcgatcccggcctttaaaaatcctccggcgaaaaacgcggcccgcactttggccatgatggggattctgctggcgatcttatttacggggattacggtgctggcgtacggctacggcacgggtccgaagcctaacgagaccgttatttcacaaatcgccgcggaaactttcggacgccatacggtgtattatttcattcaaggcgttacatccctgattcttgtgcttgcggcgaatacgggcttttccgcttttccgcagctggcgtttaatttagcgcgcgatcagtatatgccgagaatgtttacggtacggggcgaccgattaggattttcaaacggaatcatctttctcggtatcgcgtccatcttgctcattcttttattcggcggccgcacggaacatttaattccgctttatgccgtcggcgtgttcattccgtttacgctgtcgcagacgggaatgtgcatcaagtggatcaggcagaagccgaagggctgggcggtaaaaatgctgatcaactcatgcggcgccgccatttcatttatggtgctgtgtattttattcgcgacgaagttcaatcttgtctggccggtgctgttattcatgcctgctgtcgtcatgctgtttttcgtcattaaaaatcactacaccgcggtcggcgaacagctgcgggtcgttgatcagcagcctgaggaaatcaagggaaccgtcgtcatcgtgcctgtcgccggtgtcaccaccgtcgtccaaaaatcgattcagtatgcgaaatcattatcggatcaggtcattgcggttcatgtttcctttgacagagaacacgaaaaaaagatggaaaagcgctgggaagagcttcataacggcgtccgcctcgtcaccctgcattcctcataccgcagtctggttcacccgtttgataagtttttggaaacggtcgaacaaaaagcgaaaaaagaacagttctccgtgatggtgctgtttccgcaatttattacgaaaaaacgctggcagaccatccttcacaaccaatcagccttcttgctccgcgtccggctgttttggaagaaggacatcatcgtcgccaccctgccgtatcattttaaaaagtaacggcaaagaccgcaggctgaaatgccgcggtcttttttgtaaaggaggacgacatggcacaaggcgcgtttgtcatcatacaaaatgaggggcgggagatattgctcgtaaatcgaaaagatattcccttatgggatttgcccgggggcagggtcgcagaaggtgaaatacctgaagccgcagccgtcagagaggccttcgaagaaaccggttataacgtgaccattctgcataaagcgggtgagtatgaaaggccggcatttgaagatacacagcatgtattcatcggggccattaccggaggaacaccgctgatgaacgggccggaaaccgccgcattacgctggtttcccccaaaccggcggccgctgttcatggtgccgaacagaagacggcaagtaaaagacggactcaatggggcggcaaatcgtaagacagttcttaaagaccgaaatttgttatccatccttgatctgctgagaaaaaagctgagagtatagcccgtgtttcaacccgtatgaaaaaggggatgaatacaggtaaaaggaggatgcagtatgccaagtaaaacagcaggacacgtaatgacggagctgcttgaacaatggggagtcggtcatatatacggcattcccggagacagcattaatgaatttatcgaagaactgagacatgaacgaaataacctgacattcatccaaacccggcacgaggaagtcgccgccctggctgccgcggctgaggcaaaactgaccggacagatcagtgtctgcctttcaatcgcaggaccgggggccgttcatctgctgaacggtttatacgacgccaaagcggacggcgttccggtgctggcgattgcgggacaggtggcttccgatgaaatcggccgtgacagctttcaggaaatcaaattagagcaaatgtttgaggacgtggcggtattcaaccagcaagtacatacggcagaagcgctgcccgatcttctgaatcaggcgatccgcacggcttacagcaaaaaaggcgttgccgttttaaccgtttctgatgatttattcgcgcaaaaaatcaaacgggagccggtttacacatcgccgatatacctcaaagctgatatagagccgaaaaaagaacatctcgtgacatgcgcgcaatatattaacaacgcaaaaaaaccggtcattctcgccggccaagggttaaaatcagcaaaagaggagctgctcgcattcgccgataaagcggccgctccgattgtgatcacccttccggcaaaaggcgtcgtgcctgacagccatccccactttctcgggaatctcgggcaaatcggcacaaagcccgcctacgaagcaatggaggaatgcgatctgctgatcatgctcggcacatcgttcccgtacagggattatctcccggatgatacgcctgccattcagcttgattcggatccggcaaaaatcgggaagcgctatcccgtcaatgcgggaatcgtcagtgatgcggctctggggctgaaagagctgacggaatacattgaatataaagaagacagaagatttttggacgcctgcaccgagcacatgaagcattggtggaaggaaatcgaaaaggatgaaaccgaagcgactcatccgctcaagccgcagcaggtcattgcccggcttcaggatgcggccgcagaggacgccgtcctgtcagtggatgtcggaacggttacagtgtggatggcccgccattttaaaatgaagaagcaggactttatcgtctcaagctggctcgccacaatgggatgcgggcttccgggagcgattgccgcaagccttgccgaacctgagcggcagtccatcgccatttgcggagacggcggattttcaatggtgatgcaggatctgccgacggctgttaaatataaactgccgattacggttgtcatattaaacaacgaaaatttaggcatgattgaatatgaacagcgggtcaaaggcaacattgactacgtcacccagctgcaaaatatggattacgccgcttttgcagaaagctgcggagcaaaaggcatcaaagtgacgaaacacgaggaattggctcccgcttttcatgaagcgctcaactcaaatgagccggtcgtcatcgacgccgtcatcggcgacgagccgccgcttcctggaaaaatcacttatggccaagcgaagggcttcagcaaatacatgctgaaaaacttctttgaaaaccaaaaaatcgaaatgccgtcactcaagaaaagcttaaaacggctgttttaagaagccggtggttataaaaaaattaacaggcagcatgcctgttaatttttttaggctttcttattgatgattatttctttactgacccccttccatggtaaggaagtggtcagcagtttgacccgcttggaagcttagaggacgggaaccgtaaccgaaagtatatcgtattaaaatctccggaaacggtaaaggaggtcgtaaaattcgcagctggcgagcgatggctgattaaaaaacttatgaaggaccagtgcaattcatctcaagaacagccagagagcggtcacaacagcgatcataaagtaatctccctcattcagtgtagttccatttttgacaaacacaagtgccgtccggttcgtctttgtccctttcggagttttaagcgcaatgttcttccctatattgtaataaacaactttaaacaaataatatgccagcgaacagaataaaaagagcaacatgaacttgccaataaacaatatcatgtttcattactcctttttgccgttttttcgttttaatatatgacggaaaagtcaggatgttatataaaaggagaagtattttaccgaggctggtgttaaacattaatgaacggttcgccgcaacatccccagatccggaacaatttcaaaacgaaagagaagcccggggattattaaaaacagaccctaatttgtccgcttttttttgaaaacttgatccaagatgaacataaagagagtgaataagaaggacaccgtaatcatatctatcagagatagattagaggtttcttttattagtagcagccataccacctgcaaaactaaagaaatagaaaaataagatatatatgtcatgatcctcatatttgttacccccttagcctaatttctcttttgtgatcttatccaaattagtaaaaaggatatccaggcccgaaaataagaaagtgatgaacaatgaaagaagaatttctccaccttgaaatatagatatgttctcaatgatatgattggaaacgtattggattgagaagtaaacagcagcccatgcaaaaatgaattcaaggatataggctgaccaagcaggcaatgtcaaaacatgagtcattccttttacaattgctgtaaggataagcatataaactaaagctaaaatactgacgacgacagaaaatatgtataagtctgaaagtgaaccatagatgatatattctccgaaaaaatgatgtattgttacagctgcaaaacaaataatcaggctggggacagtcacagcgaagaacagggagaatccaataagtatgatgaatgctgcatgagctaagcggtttggcggtgtatccacgatctctttttttaatagaaacataaaaataagagatgaaatcacaaggcagcataagaaagtgagcaaaacagtaaaaaagacagtcattttgacatctccaatgaaaaagtgctattagagtgaatctaacagcactttgcattactttatacgtattttcctgacgatcatttatgaatgattttaaaatgctttcattgctaaagttgtcaaatgagcgaggtttttagcctggctgtcagaaagtccggactttttaagtgaaagataaagattcttttccacgtcagtccagcttaaggcgacatactcgttcagcattttctttaaaaccggttcgatgtgttcattgaaaacggattcgagttcatttcttattttctttcctgctaatttttcaacaagattgaataattttgttttatttttcagcacttctctgattacatctttgactggttttgacacagatgcatcgctttgtgctttaagtccgtaggaaaattgcgtatcagtctgataaaaaaatgatttggtcgttccagtggcattggcagtattatgatgattttctttagctaaggacgcggggacaaaagtagtagttacaagggctaaagatgcggcaaacagaatgcctttagctgcgtgtctaatgggaaatcctcctttagaaatgtagtgtagagagaaatgaaagactatgtatttaggtgggaccgatatgatccgctttgaacattttcccctctcagataccattctatcaataggtatttttggggtaaataggattttaatacagtatttttcttataattcaaaatcttctttagtaggattcattttggctgcagtttcgacgagatgggacatgggctggagcctatataacacatgtacaggctgattgaggcggaatcacattatcggagcggtttttataatgcaggcttaggtaaaaaaaataaacaggcggcatgcctgtttattttcgtttgcgtgagagagcgaagaaaaacgggaaggcggaaccggccaaaaacgtaccgaataaaaacatgcctccgatgaacacatgatagttcaccccgccgatccaaagccccgtgattaaggaaacgatacttaatgcgatcatcacaaagccgggaatcagacgtttcttacccgttgtccgataagcaaaaagagaacagaagataccgatgacaatcggcacaatccacagataaaaaaggataaatactgacataagcaaaactccgatttttcttctatcataccaaaaacgcccggaaaaagatacgaacggcacccggcgtcaagagaaaaactggccgctgacggccggtttttttctaacggaatgaatcgtagatcacaaacagattaagcgcgatcaccaaaaccgcaatcagccaggcgagagccgtcacccattttcggtttgtcagggcgcccatcaggcgtttgttgcttgtaaacataatcagcggcacgagcgcaaaggagatgccgaatgaaagaacgacctggctccatacgagcgcttctgtggcgttgacccccgagataatgatgatcatcggcggaatgatggtaatgaaacgccgcaaataaagcgggatacggtaacggatgaagccctgcatgataatatcgcctgacaatgtgccgacagaagagcttgaaagccctgcggccagcagcccgatcccgaagagaatggctgaagccggtccgatatagtggccgaattgctgataagccacgtctaaatcttctacatacagcccgttcttgaagaaaagcgcggcggcgacgatgagcatgcttgcgttaatcgccccggcgatcaccatcgcgatgagaatgtcaatcgtctcgaatctaaaaatctttttccgctcattatccgtttttccgacgacacggcgctgtgtcagtgcggaatgtaagtaaatggcatgcggcatcacggttgcgccgagtatcccggttgccaagagcacactgtccattccgtcaattttcgggataaacagcccttcgagaacagagccggcgtcaggtttggcaaagaaggtctgcagagcgaaggcgatcaccacgacaaacagaagtccggcgatgcccgcttccagcgcccggtaaccccggcgctgcagctctaaaatcgcgaatgatccgatcgctgcgataatggccgcttcaaccatcggtatgccgaacagcaggttgagcccgagcgccgcccctataaattctgccaggtcagttgccataatcaccagttcaccctgtatccacagcccggcggatacccatttcggataccggtctctggcgatttccggaaggtttttacccgtggcaatgccgagcttcgcggaaagaacttggattaaaaaagccatcaagtttgaaaagaggatgacccacagcagcatatacccaaatttcgaaccagctgagatattcgtagcgaagtttcccggatcaatgtaggcaatcgccgcgataaaggctgggcctaagaaaggcagaagccgcttgaatcccttgcttttgccgtcaagtgcatcctgcacggcttttgcttgcagtgattgtgctgagatgtctttgctcattatgtctcacctaaattccgatagatttttagctaaataacaaaaagtttcctagatgcaaattattttatctacatcataaatccgctattatgagatgtcaagttctttatgttcaataaaccggcacattgatgccctgttttatctatgatatgtatcccgccgaagaaaggtccgaaaatgaaaacggcatcgttccgggaaagaagcgatgccgttcgcaaagcgtgtttccgcctccaatcatgcacggatgcgtggagcgttcttttaaaaaggtgaaaagaggacacttgcctatataacttcacaactttctgtccggtgcaactgatcctgagaaaaagacgcagtatttcctccgttttcccgggtaaatagaataataatgtttctttccattggaagataaaacctttctgtaccattcaaatgacctccggaaaaactccggccgctctgaataaacgtttgaatcaacgatatatcagtgattccagtccaataaacggctgttatctatcaaaaaaagaatcggcatggtcacttgcgaagaaaagaagttggagcattagacttatttcagtctcccgggcaaaaaagtataataacgtcaggaaagctttccggccatatgataaaagagggggaattttcttggtacgtcgtttgtcgatcatttctttagccatgatttttgctgtttctttattcgcttttggcggctctgcatcagcagcagctttcaaacctaaagctgaaccggacgtttccattttagccagcgggggcacagtcggtatttacggtgctaatatgcgctcatgctctaaggtaagctgttcaacgatcacaacattctcaagcggtaaaaaaattacaggttcttgggtcaccggagaatatgttcaaggccactacaccaattctaataaatggctgaaagtcacgtatgcaggagcgacaggctacgtttcagtcaccacactatcttattattacggtttataagcagaaaaacctcgttctcttgagagcggggtttttctatattccgattcaatttccgcgtttcgtttcatcctcgtgtttcatcagctgatcgatttcttccttagaagcgttttttttccactctttcgcctgacttgtcgcaatgggaatagcccgtccttcttcataaccctcatctaccatcgcattcgcgatttcgatcgcttttttcttcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaagtacagattgaatgcccaccacatgagatcaaaatcaccgataaatacccaaaaggcaatcgcttgcaggcctgaacaaaaggtcagcacaagtgatattaatgcgaaagggcgccataacgcatgtttccgtttataaagaaacaagctgtacagcccggtcaatgaaatgaaaatatctaggggaaagaatgaccagttccaggccattatcatggcgttatcataatctttaaacgccatgttttttggaatccactcaaaaaaagtaacaatccaataaatgataaatccaatatctgtaatgaggaagagaacctttaaccctttcatcatctgtttctgtccgtatgaacgctgatgccgtttgatgacgtttcactttcggaaataaagtttaaggaaacgacaccgatgatgatcagaagaacagagacagcttttataacagagaactgttcatgaaagaaaaaaattccgatcgcggaaatcagtacgatccccattcccgaccagaccgcatacgcgatggagacacttatatatttcaaagtcaaagtaagaaaacaaaggctgccgatataaaacaataacaataaaatacttgggacaagttttgtaaacccatttgataatttcatgctgaccgtacccaatacttcaaaaatgatcgctaaacttaaataaatccattgcatacagcattctccttcaatcgtattattcaaaattatacaatatatagaatttgaagaaaattaatcaatggaatgttttccggataaaaagtccggccgggtgtaaaaagaaaacgccataaaggtatactatgtagaaagaaatcagaaaggacgtgcaggacgggtgacagaagagcggacagacctggaaagacaactgagagatattcaaaaatgggaaaaggcgcagcagagggcgatgttctggcaaacattcacccgcttgccgtttcagcttttggacaagctgacaccgcaatttattcagaggaaaatcggactcattctcgatgaaacgggaacgtttattcagtcaggcggacagtaccttacatcagaaaagcgcatcatgaaaaagtttcaaaaacggctgccgtacggtacatgtcaaacgcttcacgacatccgcaatgcgccgcttgccgtcatggacgaaatcgcagaagccatagcgcgtacaagcgtaaaggccgcgacggtgcagggagccgcaacgggagtcggcggcgtgtttacgcttgcggcagacattccggcgatgctcggcctgtccttaaagacgctgcaagatatcgcggttgcttacggctttgatccgaaagacaaaaaagaacgcgtgtttatcgtcaaattgcttcagcttgcatccagtgacgtcatcggaaaaaaagcgatcctgcaagatttacggcaatatgatcaaaacgaccaaacctatcagcgcgtcgcctcgcaaatccaaggctggcgggaagtcgtttacagctaccgcgatacgttcgccgcgaaaaaactgctgcaaatggttccggccgcaggcatcatcttcggcgcgtccgccaaccgtgcagctttagaaagcatcgcggaaacaggcatcatgctttataaaaaacgccggattctaaaacgcatgaacgatacagaatgataaaaaaccacccgaaaacacattcaatgtgttttctttgtttagcagttctgaaatcgggaaaccaacaaccaacaccaattaaaggaggaattcaaaaatggcacaagataataacaaaatgagcagagaagaagcaggtaaaaaaggcggagaagctacaagcaataaccatgacaaagaattctatcaggaaatcggtgaaaaaggcggagaagccacaagcaaaaatcacgacaaagaattctatcaggaa

SEQ ID NO: 118 - DNA, 98387 bp, Bacillus velezensis FL50S
gtcccgtccggaccgccatttttattgtaaacgaaacgatcatgttttcgttttttttgtgttttcttttaatgctggcagcttggtatctaaccaagctttcttttatatcgttaaagtcttggatattgaaacataatccgatacactagaaagagctgtatttcacaagagcgtcagaaaggaagacgggagatatatggatgagtttgatttgattcacagtattacaccgcattcgcattatcatccttccgtcgatgtagggatcggtgatgatggtgcggtttatacagcgtcaccccacatgcagcaaattgtctgccttgatacaatggtggagaatgtccattttaaattagagtattcctctcctcatgatatcggttataaggcgcttgctgttaacattagtgacgtggcggcgatgggaggcattccgaagttttatttggtgtctctagcggttccttcttgctggcagaaagctgacgtccaggcaatgtatgaaggaatggcggaactggcgaaactatatcaaatggatttgatcgggggagataccgtctccgcttccggtcaagccgtaattaccgttactgtcatcggagaagttgagaaggattgcgcttgtctgcgaagctcggcaagacccggggatgttgtgtttgttacgggggatatcggctcgtccgcagcaggactgtctcttttgttgggagaaacacatccttctgcttttcatacgagtgattattttatccaaaaacataaacggcccgttccgagagttcaagtcggccgcttctgctctcagcttcagcgcgcggctctgaatgatatcagtgacggattggccagtgagctgcatgaaatagctgcggcaagttcagttacgatagaaattgaagaacaacttctgccggtgcatccggatttgcctgaggcagattctgagtggaagaaatgggtgttattcggcggtgaagattttgaattggttggaacggtttctcagcaagagtggacctctctgcttgattactgcactcaatcgggcattccgattgcgaagataggggcggtatctgaacggaaggaagcatgtgttcttttgacagccaatgatcagagacaaatcgtccttgagaaaaaaggatacaatcattttaaataagacgggtgactcactttgaagacattacaatggagaacgaaaaaccccgaagaaacgaaagccgtagccaagcttgccgcttctttggcaaagccgggagacattttgacactggaaggcgacttaggcgcgggaaaaacgacttttacaaagggttttgccgaaggactgggaatcacgagagtggtaaacagcccgacttttacaattataaaagaataccatgacggttcgattcctctatatcatatggacgtgtatcgtatggaggatgaaagcgaagacttagggcttgaagaatattttgagggacaaggcgtctgtttaattgaatgggctcatttaattcaggatcagctgcctgctgaacggctgcagatcgtcatcaagagagccggtgatgaggcaagggacattacctttacggcttgcggaacacggtatgaaacgctttgtgaggagataaataaacatgacaatactggcaattgatacgtcaaattacacgctgggtgccgcgctcgttcgagagaaaacggtgatggcggagtatattacatatttaaaaaagaatcattccgtgcgggcgatgcctgctgtcaattcattgctgaaggattgcggcctaacaccgcaggaccttacgaaaatagcggtggcgaaaggacctggatcgtacacaggtgtcagaatcggtgtgacgctggcaaaaacattggcatggtcgctgaagcttccggtttccgctgtctcgagcctggaggtgctggcggctaacggacggcactttcaaggactgatctgcccgttatttgatgcccggcgcggacaggtatatacgggactttatgaatatcaggacggccgcttacaatccgttcttcctgatcagaatgtgcttttgactgattggctcgacatgctgaaagaaaaagcgtctccggttttatttttagggcatgatacagccattcatgaagaaaccattctgcatgggctgacaaatcaagcagtgataggaacggctgcacagcataatccgcggccgtcagagctggcgtttttaggcttggaaaaagaagaagcggatgtccacagccttgttccggattatttgcgtctggcagaggctgaagcgaaatggatggaatctcaaaaatagggtgatagggatgaaaacgaaaacggcgattcgaagcatgcggccggaagatattgatcaaatttatgaaattgaaacagcatcctttacttctccgtggacgaaggattcattttatcatgagcttttggaaaatccgtatgcccactaccttgtcattgaaaaggacggctgtctggcggggtattgcggaatctggattattatagatgacgcgcagattacgaacatagccattaagccggaatatcggggccaatcgttgggagaagcgctgtttcgctctgcgatagaattgtgcagagaaaaaaaggcaagaaggctctctctcgaagtcagggtctcaaatcatcccgcccaatccttatataagaaattcggtcttcaggccggaggaatcagaaaacaatactatacagataacggggaagatgcgttattaatgtgggtgacattacatgagtgaaaaacaagatatttatgtattaggaatcgaaacaagctgtgatgaaactgcggcctcagtcgtaaaaaacggaaaagacatcatttcaaacgttgtcgcttctcaaattgaaagccataaacgtttcggcggggtcgtgcctgaaatagcgtccagacatcatgtggagcagattacccttgtgattgaggaagctctttcaaaggcggagatgggctttgatgatcttgatgcgattgccgtaacggaaggacccggacttgtcggagccctgttaatcggggtcaatgcggcaaaggcgttaagctttgcccatcaaataccgttagtcggcgtccatcacattgcgggccatatttatgcaaacaggctgataggagagcttcagttcccggcgcttgctttggttgtgtcaggcggacatacggaattggtttatatgaaagaacacggttcattcgaggttatcggtgaaacgctggatgatgccgcaggcgaagcttacgacaaagtggcaagaacgatggggcttccttatccgggagggccgcagattgataagctggctgctgcgggaacggattccattccgcttccgcgtgcgtggctggaagaagggtcttacaatttcagcttcagcggcctgaaatcagccgtgattaacacgcttcataacgcctcgcaaaaaaatgaggtgattcctccggaggatcttgccgcaagctttcagcagagtgtcattgatgtactgacggcaaaaacctctaaggccgcgaaagaatacagggttaaacaagtgctgcttgcagggggcgtagccgctaacaaagggttgagagccgcactgcagcaggaattcagccattcgggagatcccgagcttgtcatcccgccgctttctttatgcacggacaatgcagcgatgattgcggctgccggaaccgttgcttttgaaaaggggatccggggctcgtacgatatgaacggacagcccggtttggaattaacatcctttgatcgtctcacgttgtaaaacgtgaggcttttttttacttattaacagataattctaacatatccacaggattgtgaatatattcagaaatccagtctggataagggactgaaagttgttagtaaagtggataaagtcagaaaattttgtggatagtgtgtataaaacgcttacttaaatggctgacaaggaggatagctgtggataaaaaagcaccccttaaagaggtgcttgactttttctattcttctgaggagagttcctcccattctgctaataagttttcgagcttttgattctgggcttcattctccgcgtgaatggtctgtactttttcatgatcctgatacacgtcaggatcgcacagcagctcctcattggcactgattttctcttcggcggatgagacggccgcttcgatttcttcaatgcgtctcaggcgctgccgttctttcttcttccattctttttcttcctcgtaagttcttttcgtatcctgtttgaccttgccggcaggctgagtctgctccttttcctgccgcttcatttcttccagttccagctgctgtgcttttttctcggtgtaatagtcatagtctcccaaatattcttctgcatgatcaggtgacagctccagcactcttgtggcgatcctgttaataaagtagcggtcatgtgatacaaataacagagtgcccgggtagtcgatcagggcgttttccagcacctctttactgtccaggtcaaggtggtttgtcggctcatcaaggatgagaaagtttgctttttgaagcatcagcttggcaagcgcgactcttgctttctccccgccgcttaacgaacggaccggtttcaggacatcgtctccgctgaacagaaagttgccgaggcatgttctgatttctttttccggcatgtccggatattcatcccacagctcgtccagcacgcgtttggacgatgtcagttcagcctgctcctgatcgtaatagccgattgtgacattggaaccgtacgtgatcgacccggattccggactgatcgtgttcataatcgttttcagcaaggttgatttgccgattccgttcggtccgacgagggcggcgctttcgcctcttgtaatgccgaaggtcaggtttttcaagagcggcggctggccgtcatagctgatggaaacatcctgtacgcgcaggacgtcgtttccgctctgttttgtaatgtcaaaacggaaggcggcggatttctcatccccgagcggctttgccatgacgtccatccgttcaagctgttttcgtctgctttgggctcttttcgttgtagaagctctggccagattgcggtcgacaaaatcttgaagcttggcgatttcgtcctgctgtttttcatacagcttcaggtctttctcatactgctcagctttttgttctaaataggcgctgtagttgccgaggtattttttgctttctgtccgtgagacctcgtacacttggctgacgactttatcaagaaagtatctgtcgtgggaaacgatcaggattgcgcctgaatatccctgtaaataatgctcaagccatgtaagcgtatcgatgtcgagatggttcgtcggttcatccagaataagcagatcaggctgggtcagcagcagttttccgagcgcaagccttgttttctgaccgccgctcaggctttgcactttcacggaatcgtcaaattttccgaagccgaggccgtgaaggatagatcggacgtccgcttcatattgatagccgcctttatccttgaaatcctgctgaagcctgtcataggttttcatcagcgtctcaagctccgccggggcggccgtggccatcttttcttcaatagagcgcatctctttttccattgctttcaggaaatcaaaaacgctcagcagttcttcttttatggtaagctgggattccaagcctgtgtgctgggcaagatatcccatcgttaattctttcggtttgattaattcacccttttcatatgaaaggtgacctgcgataattttaaggagagttgatttgccggctccgtttctgcctactatggcgatgcgatcccgagatctgacttcaagctttatattgtttaaaataggatcagcgccaaaagatttggatagctgattaatttgtaagatcatcatattatttcacctctgttataataagttaagtgtagcttatcaacctgctgtcagcaaacaatacatcagaattggaacattataggataagacatcagggagaaaatagtgtatgatcagaagtaaggagagtttaaatatgaatggattttctcattttaatgaagaaggccgtgcccgcatggtggatataagcgataaatcttcaacagtccgtactgccgctgcgatatccagcgtacacatgaaacatgacgtgtacagcagaatcaaaaaccgcgagatcggaaaaggagacgtgctggctgtcgcacaggtggcaggaattatggccgcaaagcagacgtcagcgattatcccgatgtgccacccgctttctttaagcagcgtcgacatttcattcggctgggaggaaaaggattccgaagccgttcttcatatacaggcaagcgtaaaaacgaaagggagtacaggtgtggaaatggaagcgctaacttccgcttcagtctgcgctttgaccgtgtatgacatgtgcaaggcgctggataaaggaatggtcatcggcccgacctgcctcatggaaaaaacaggaggcaaaaacggtgattttaaaagagatgcatctgagtataaagtggaggaccaatcatgaacaaggatcaatcaaaaattccacaggcgacggcaaaacggctgccgctttattatcgctttttaaagaatttacacgcctcaggaaagcagcgcgtttcatcagctgaactgagcgacgcggtaaaagtcgattcggccacgatccgccgggatttttcctatttcggggcgctcggcaaaaaaggatacggctataatgtggattacctgctgtcatttttcagaaaaacactggatcaggatgaaacgacgaacgtcattttgatcggtgtcgggaatttagggacggcgtttcttcactataatttcacaaaaaataataacacaaaaatatctatggcttttgatgtgaatcagagtaaaataggaactgaggtaggcggtgtgcctgtctttgatcttaatgatttagagcttcacataaaggatgaacccgtggcgattcttaccgttccggcggttgccgcccagtcaatcaccgatcggctcgtgtcgctcggaatcaagggaatccttaactttacgccggcccgtttgaatgtgccggatcacattcgaattcatcatatagatttagcagtagagcttcaatcattggtttatttcttaaagcattattctgttttggaagaaattgaatagcgaaaggaggagctgcacatgatcggtcctggaagcctggcggttatcggtgtggtagcggtgattattttcggtccgaagaagcttcccgaattaggaaaagcggcgggggacacgcttcgtgaatttaagaacgctactaagggattagccggtgaagaagaggaaaaaaagaaagaagaacagtaagataggatgacgcgtatgagagtgaatcaaatgacgcttgtggagcatattgccgaacttcggaaacgattgctgattgtggcgttatcctttacggttttctttattgccggcttttttctggcaaaacctatcattgtgtatcttcaaaaagccgatgaagtaaaagagctcacccttaatgcttttaacctgacggatccgctgtttatctttttgcagttcgcgtttatcatcggcatcattttgacttcgccgattattctctatcagatttgggcgtttgtcagcccgggtctgtatgagaaggagcgcaaagtaacactcagctatattccgatttcgatcgtgctgtttgtcggcggtgtgtcgttttcttattatattttatttccgctggtcgttgattttatgaagcgggtctcgaatgacctggatgtcaaccaggtgatcgggatcaccgaatactttcattttctgctgcagctgacgattccgttcgggctgctgtttcagatgccggtgctgatcatgtttttaacgagactcggtgttatcacgccgatgtttttatcgaagatcaggaagtacgcatattttgtgctgctcgtgatcgccgcgatgattgcgccgcctgagctgctgtctcacttgatgattaccattccgctttgcattttatacgagatcagtattctgatttcaaaagcggcgtatcggaaaaggcagaccggcagtgaatctgatcaggacgtatcagcataaaaaagccatttctcaatgatgagaaatggcttttcttttattatttttgatttttcttcactttaaatgagaaggcgaacattttaaacgagatgctgatattataagcggcgaaaaccatcagcagtatggaataaaaagaccacatgcttcccggagagcttgcggccaaatacgtaaagatacagccgactgcgaaataaatcaagccccaagtcattgggttcctcatacaaacaatcctccaataattaattgcatttgctcactatgctgttcaatatatttttgggcggggccgagctgcatgaccacgacaatggtattcatcatgacatgggcgaatatcggcacaataatccgtttcgtctgcacatacaagaacgcaaaggtaaagcccatggccgtatacagcagcaggtgcgtgaggtcttgatgcacaatgccgaaaatgacggaactgatcagtccggcgataaagaaattcgttttttcatataatacaccgaagatgatcttccggaaaatgatttcttcaagaatcggcccgacgatagaagaaacgataatcatgagcggcatggctttaataatgttgagaatggctttcgtgttttcggaaccgctgcccacatgaaagacatactgctcaatcatcccggcgattccctgagaaaataaagcgagccatattcccgcgaccgcccagagaacggacatgccggcggatgctttcttcccgtttcttaatgtctgtttcggcgcggttctcaaaatcaagagaacgataatcaggcagataaaaaagcttacgacggaataaatcccctgagccatggtgagattcgcattcgtagggtgcccgcccgcatagccgaatttgtacattaaaggaatgccgatcaaggcggaaagctgcatgataacatatgtcaaaatgatataccaatactgttttctcaaatgatatgtactcctttatcctataaaatcaacttatttgttcttattgtaacacaagtgaacttgacgtgaaaaaaggagaaaatcagtgcgagagagaatcatgtaagcgtgaaaattttttattcttatgacttgaaattggaagtgagattctttattataataactgtgttagcactctttagagctgagtgctaaaattacatattcatactattgaggaggttattacattgttaaagccattaggtgatcgcgttgtcattgaactcgtagaatctgaagaaaaaactgccagcggaatcgtattaccggattctgcaaaagaaaagccgcaagaaggcaaaatcgtggcagccggttcaggtcgcgtgttggaaagcggagagcgcgttgctttagaagtaaaagagggcgaccgcattatcttctcaaaatacgccggtactgaagtgaaatacgaaggtgctgaatacttaatcttacgtgaaagcgacattttagctgtaatcggctaagcaaataaatatttttaaaaattcgaggaggtttcgttaacatggcaaaagatattaagtttagtgaagaagcacgccgcgctatgcttcgcggtgtcgatgcgcttgctgacgctgtaaaagtaactttagggccaaaaggacgcaacgtggttctggagaaaaaattcggttctccgttaattactaatgacggtgtaacaatcgcaaaagaaattgaacttgaagacgcgtttgaaaacatgggtgcgaagcttgtagctgaagtagccagcaaaacaaacgacgttgccggtgacggtacaacaactgcaacagttcttgcgcaggctatgatccgtgaaggcctgaaaaacgtaactgcgggggctaaccctgtcggcgtacgtaaaggtatggaacaagccgtaactgttgcaatcgaaaacttaaaagaaatttctaagccgatcgaaggcaaagagtctatcgctcaggttgctgcgatctctgctgctgatgaggaagtcggaagccttatcgctgaagcaatggagcgcgtaggaaacgacggcgtcatcacaatcgaagagtctaaaggcttcacaactgagcttgaagttgtggaaggtatgcaattcgaccgcggatatgcatctccttacatggtaactgactctgataagatggaagcggttcttgacaatccttacatcttaatcacagacaaaaaaatcacaaacattcaagaaatccttcctgtgcttgagcaagttgtacagcaaggcaaaccgttgcttctgatcgctgaagatgttgaaggtgaagctcttgctacactcgttgtcaacaaacttcgaggcacattcaacgctgttgccgttaaagctcctggcttcggtgaccgccgtaaagcaatgcttgaagacatctctgttcttacaggcggagaagtaatcacagaagacttaggccttgacctgaaatctactgaaatcggacaattgggacgcgcttctaaagttgtggtaacgaaagaaaacacaacaatcgtagaaggcgccggcgacactgaaaaaatcgctgcacgcgtcaaccaaatccgcgctcaagtggaagaaacaacctctgaattcgacagagaaaaattacaagagcgtcttgcgaaacttgccggcggcgtagctgtcatcaaagtcggcgctgcgactgaaactgagctgaaagagcgtaaacttcgcatcgaagacgccctcaactcaactcgcgcagctgttgaagaaggcatcgtatccggcggtggtacagcgcttgtcaacgtatacaacaaagtcgctgcagtggaagctgaaggcgatgcgcaaacaggtatcaacatcgtgcttcgcgcgcttgaagagccgatccgtcaaatcgcacacaatgcaggccttgaaggatctgtcatcgttgagcgcctgaaaaacgaaaaaatcggcgtaggcttcaacgctgcaaccggcgaatgggtaaacatgatcgaaaaaggtatcgttgacccgacaaaagttacacgttcagccctgcaaaacgcagcttctgtagcagcaatgctcttaacaactgaagccgttgtcgctgacaaaccggaagaaaacgccggcggcgcaggaatgcctgacatgggcggaatgggcggaatgggcggcatgatgtaaaccgacaaaaaacccttgatttacaagggtttgtcggcaacggacgtcatttttaatgccctcttgatgccatttaacttttcgaggcttctcatgagttcaccgaacttgtgagaagcttctttttttctgtcttgcgggctttcgattaaattatgtaatcgattaaagcttcaaattcaaaacaaaaaacatagcatgttcatcaaagaaatattaacggcttttcctatagcttaatattatatttttctttaatttttcgcatgtaatcttctacgtctgatttattttctgggtgtcgttctagatattgatcaacaattttatttaaatatttatagaaattttcgtaatctaaaattacttcttcatcttctttgactgctgggtagtcgaaataaaaagcaataccttcatctccaaagtaatcatcttcccactcttcgtagtcatcagcaaatacacaccagacattctctataccataaccttccccgttggagaatttctctaaaattcgtaaaaaacgttcatcacccatcacctgaaaaaagtagttaattaaatctttacttttattatccatttcattttcactccgaattatttaatcatttaaagttgggaaaaaatttgttatttctccagttgcttcatcaatataaccttcaaacttgagaccgtttttagcgtatccagttacttttctcccgactacttctccatttctcattgcttcttctccccactgcaacatttgttcgtttgagatcttctcgggatcataaactgtctttggagtacgaactttttttagttctccaggtttgatatttccctctctatctaatgcaggtaatccatattcaatttcatagataccatcaattgtggggtgttccctttttgaaattatacaactctttaaatcccaacctttatcaataaatgccttctcaaaactctgtagattgtgaccgccgacaatacctttatttttctttctgactatatcttctacctcaactaaatgggtatcatatccttgcctaaaagtaacatttattttggaaaaagcattatttttttcttcttcaattatactttttaacaatggtgtgtttttaacattgtgagtattctcaatatcttgtgcaattcctacaagtgcaggttcatatctgtttttaaaaaagggattaaaaaaattgttgccttttgtaattcctttatttacatgagcagcagctgttccgctctcaaccactttacctactttagaaagcttggcagtggtttgcactgcggcacctgcaccttttggaccaacgatattaccgaccgcataactgatataatgtgctcttgtgtatgcatcgccatttatcattttatcattccatgaatcgacgatgtttttccaaattattttagggtaggaggggacacttaagactgttgtaatcgtttttgtaagttttagttcaatagggagttgtgaaaattcccatgcgcccacaaccaagtccttgatgccatatatcgtatcatcaatcgcatcgttaagcccatcattaaccccatcgatgatatccaatgccgttttacctgcgttgattacactttcaccgacagccttcagctgttttgcttgttcaagctgtaccacatactgaagctgttcaggggtaagactctcatacccgaccttcttggcaatttctaagtaatcatccgggtccgtcactccgtcagctagcttcttcttcaattctttgatttctcgttctttcgcttcgtctttcttgatcttcaaataagcttcagtttgtttctcaatatcgcctttcttcttatgtatgtcactttctcgataagcattggcattgtagtgaatgggtgtggcattcttgcccttgcctgtagattcctcaagcttttggaagtctttcttgatgaattgctcgattggctctgactgggcatattcagtaacaagtgctttgtccacgcttcctaatttatcgactgtttttttacgtttgtcctctgcatctgcaagttcgtctttgaagtcttctgtcgagaacaaatcaagcggaagaatatcattgatatcaagtaggatatctttcattgctttcttctgttcagacataatggattttgacttggtgtaggcattagccagttcgtgttccaggaaggattcttctatgtatgcgccagacaagctggcgtcctctaaagcgcctgaaatgcttgttaaaaaagcaatcttcatatcaattagatcaatccaattgtcagccacaccagcgtgatcatgataaaatgctttgatgttgtcagcgccttttccggaaaactcactgtcctctaaatcagttacggctttgaaggcttttttaagattgaccatctggcttcttaattctttgtattcttttgcacgtttatctgcttctgaaagcagtgttttggcttcaaatactttcatattcatatcctttcatttaaatagatcaacaagattttaccatgggaaaatgaagaaacagacgaaatgtgatacaaaagtgtgaaatgatcaatttgatctgtgttattttacctatatgaatcactttttgggagactggcaatgtcgttagacggttccagttggatgtaaagctgacggctttgatgaatctaagaaaaagcgaaaattgaagaagcgctattaatgaaaaggatccatcttttattaggatctcagagtcgagaaaatttctataccctgtttgcttacatttggtggtgtaattcttaaaaagtacataaaagatgttgacggagtatttttgaagtgataagattcaatggcaatgaaaatcagtaattttaaagaattactttttgaagagggcgggatatgcgacttgaagagattgtgacggttaaaatagggagaaatctttctagaggacacgagaaaaatgatccgacattagttgcttatacatatgaggatttaataaatgatttagatggctcgtttctagactcacaagttagtcttggtgctgaacaatcaaatcatagagaacgctatttgagcagtgccggggatgttgttttcagctttgtcagttccaaggctgggatcgtgagtaacttacatcacggaaaggtgataaaccaaaactttgcgaaactcatgattgaacacaatgatttggatagtcgatatttatgttatgcattaaatgagtcgcacacaatgaaaaagcaaatggcgatttccatgcaaggaagtaatgtaccgaaattgactccagcgatattaaaagaattggagatcaaattaccaagtatagagaaacaacggacgattggaaatgcttatttctgtttgagaaagcgtcaagctttggcgaagaaacaagcggaacttgaagagcaactttatttagaagcattgaagagattagaccaacaatagaaaaagtgaggaacacaactatggctgaattacactcaaaattatttagtgccgcagacaacttgcgaagcaaaatggatgcatcagaatataaaaactacttattgggattgatcttttacaaatacttgtctgataagttattagaaaaagtcgttgaaatcgcagatgaatctttagaagaatacaacacacaagaaaaacaaacgcaattgtaccggaatttattagcggatgaagagatcaaaaatgatttgattgaaacgttagtggatactttgggctatgatattgagccagagtatttattcaatgtattagccaatcaagcgaaacaaaacacattccagctgaatgatttgaataaggcatttatcgatttgtctacgaaatatgaccaattcaacgggttgtttgacgatgtagatttgacatcaaaaaaactgggatcggatgatcaacagcgaaacattacgattactgaagtattgaagaaactaaatgatgtcaatgtaatcggtcatgatggggatgtcattggggatgcctatgagtacttaattggccaatttgcctcagaagccggtaagaaagcgggagaattttacacacctcatcaagtatctgacatgatggcgcgtattgccgcaatcggtcaagaagacaaaaaattgtttagcgtatttgaccccacgatgggatctggttctctaatgttgaatattcgaaactatattcattatccagatagtgtgaaatatcatgggcaagaactaaacacaacaacttttaatctagcgaagatgaacttaattttgcatggtgtgaataaagaagatatgcgtttacgcaatggggatacattgaacaaagattggccgacagatgagccatatacctttgattctgttcttatgaatccgccttactctgcaaaatggtctgcagatgctacattcttagatgattcacgtttcaatcgttacggaaagttagcgccaaaatcaaaagccgactttgcttttcttttacatgggttctaccatttgaaagattcgggaacgatggccatcgtcttaccccatggggttctgttccgtggtgcggcagaaggtgtgattcgcaagaaattattagaagatggcagcattgatgccgtgattggtatgccagcaaacttattctttggcacatcgatcccaacaacagtcatcatcttgaagaaaaatcgtagtacccgtgatgtgttatttattgatgcaagtaaagagtttataaaaggaaagaaccaaaataaactttctaaagaacatattgataggattgtcgaaacgtataagaagcgagaagacgttgagaaatatgcccacgttgcaacattcgaggaaatcaaagagaatgatttcaatttgaacatccctcgatatgtcgatacgtttgaagaagaagaacctgtggatatggttgcaattggctcgaaaatcaaagatattcgaaaagaaaaagcggaactagaagctagcttgtatgacatggtttcttcattgcaatatgatgaagaaaatgcagagtggatcaagggtgcgttagaggtgtttaatcgtgggaaataagcgtgtaccagaagtgaggtttgcggggtttattggaaattgggaagagcgtaagttgggggatttagcagatttctcaaaaggtagtgggtattcaaaaggtgatttgactgataaaggtaaaccaataattttgtatgggagattgtatacaaaatatgagacagttatagattgtgtagatacttttactatagaaaagaagaaatccgtattaagtaagggtaatgaagtaatcattccatcttctggagagactgccgaagatatttcaagagcatcagctgttagtagatctggaatcattttgggaggtgacttaaatattgtacacccatttaatgttattgacccggtgttcctagcccttactatttcaaatggtaaacagcagaaagaattaagtagacgagcacaaggtaaatctgttgttcacctgcataattcagatttaaaaggagtaaatctacttttcccgataaaagaagaacaaactaaaatcggcaacttctttaaacaactagacgacacgatcgctcttcatcagcaagaactaaccaccctcaaacaaacaaaacagggattcttgcaaaaaatgtttccaaaagaagggaagtccgtgccggaagttcgtttctcaggttttactggcgattgggaacagcgtaaacttcgtgaaatgttggcagagcctgttactgatggacctcatgaaactcccaaacttgaagagagtggaatcccatttatctcagttgatgcaatcgttgataatcagattgattttgacagaaaacgtggatatatttctgaagagattgatgagttgtactctaaaaagtacagacctcaatatcatgatgtcttcttggttaagtcaggttcaactgtgggtaagacggcaatcgttgaaactaaagagcgttttaatatttggtctccattagctgccatgcgcgttggtgaagtgtctgatccgtactttttgtatttcttattgcaaacaagaaagatgcaaaaccaagtaaaagataaagcatctagcggtactcagccaaatttaggtatgcgagaacttgaaaaattccatacacaaatcacccctaatcttgaggaacaaaagaaaatcggtgcctttttccagcaactcgacaatctcatcacccttcatcagcgtgaattagaagccttgaaaaaaacgaaaaaagcatttctacaaaagatgtttgtgtaacgaataaagagggggagaatcatggcaactatccagcataaagatgaagcagaggtagagcgccgcctgattgaagtgttaggtgaagggtataatcagtggaattatcgtcctgatttgaaatctgaagaagacctgtgggagaacttgcgtcaaaagattacgcaaaataacttatcagaaattggggaacatccaatgactgataaggaatttgacacaataaagacagagttattatcgaaaacacagaccccctttgatgctgctaaatggctcaaaggggaaaatggaattgctcgaattacgattgaacgtgaagatgtttcattgggttccatgtcgttggtgctgtattccaatcaagatattggaggcggcatctctacatacgaagtcgttcaccagatagcgaaacaaaaagcaaacggtgatggtcgaaatcggcgatttgacgtgacacttctcattaatggattgcccattgttcaaattgagttaaaacaggccagtgcaaaagacggcgtattccaagcctatcatcaaatcaagaaatacgcagaagaaggaatgtttcgaaacaatatcttttccaccctgcagttatttgtcatttccaacgaacaaacgactcgctattttgccaatgcgcttccaaaagatatgcataagaaattgatctttagctggcggacaacggataatcgaaaagtagaaaatctctatgagtttgtgaaacaagtgttaaacattccagatgcacaccgcttgattgccaattatacaattgtgagtgaagaccaagacaacaaagctctagtggtgttaaaaccgtatcaaattcatgccatagaagccttgtttacgtccgccatgaggcatcaatccggctttgtttggcatgcgaccggttcaggaaaaacgttgacaagttttgtgtctacgaagttattggctcgcaaaccaggtgtagaccgtaccattatgctgattgaccgaaaagacttagataatcaaacgacgacagaattcaccaaatttgcttccgaatttaataccggtatttcttcaggtgatgcaatatcgaatagcttgattgtcggaactggaagtgcgaaggagttaagtgatactctactgtctgatgccaattccaatacagtgattattaccactcgtcaaaaactagaagctgccttgcgctatgcccaaaggcaagaggagcaaaaaggtactcagcgctttaagaaactgctgggacaacatattgtctttgtcgtggatgaatgccatcgtgcgttaagtgcagaaggcatggaagtcattaaggggttctttccaaattcgacttggtttggatttacagggacaccgatatttaatgaaaataaaaaacaagctaaaggccgattagctcgcaccacccgtgaccaatatggggacgtattgcacacgtacaccattaagaatgcgttagacgatggtgctgttttagggtttcaagtagagcatgaagatacaattgaccccacttcattaaataatcatattttcgaacagctgcgtcatcaagaaaaatacgccaattgtagtgatgatgaaatcaacgatatgattgatcgaatggatggaatcgaaaaagaagcataccttgaaccatcttcgttcgagaatgatgaacatattcaaaaagtcattcataagattttcaggccggataatgcctatattaaatttgattttcaaaacggccgcccgcaaaaatcagctattttaacaacgagttccattgatatggcgaaacgttactatcaggcaattaaagaaatgacgaaaggtccagattggttaacaaaagagtttgcgggacacccgatccgaacaggtcgtacaattgaggatcctgactttcctcggattgcaattacgtattcaatgcaagaaaatgaggaagattccaaacaaattcaagatgaaatgatggaaattattaaggattataacgattactatcatactgcttggtcgatagaagatattgaacgatataatggtgatattaacaatcggttagctcgtaaaaaaggggaattcaaagaatttgggaaacaaattgaccttgtcattgttgtcgatcggttattgactggttttgatgccccaacgattcaaacgttatttgtggatcggaatttaagttatgccaatttgattcaagccttttctaggaccaatcgtacatatccaggaaagacaaaaggattaattgtgacatttcgtaaaccttttacaatggaacaaaacgtaaagaatgcgacgaagttatattctcatgcacaagaggattctagtcttgtttacccaacgtatgatgaatcgaagaaacgttttaagaaggctcacaaagcgctaactacgttaattcccaatccaaccgatattgatgagcacacatctcttgaaacccgaattgagttcgtgaaagcatttcaagagctaaacaattcatacgaagcgttagttacatatgatgactacaacgatgatatggaaaaatcagcagcacttcaagaacaggtggaaacactagaagaatatattggtatctatcacacgattaaaggttcacttatagatgaagagcgtcatgatggcccggagccggatttctcggacattgaattctatggagaaaacgcagtgaagatctatgatattgattcaacgtatattgatcgactattagaaacatactcggccaataaccagaatatccgtgatgagatcgaaagcgcacttcaaaaactggagaaatcagacattgttaaagatgtataccgtgagatgttaaatgccattgatacgaaaaacgtagatgaagaggaagatattcttgtagtgaaaagacgcttcttcacgaaaaaacgcagccaagcagttagggaatttgcgaatacttggtttgtggaagaggatgagctgcatttatctgcagttcaatatgtgataggggcagatcctattccgaatatcgggggaatcatcaatagcaagcaatttgatcagtataaagccgtacatccagatgcaaaacctttgaaatacggaccagagttgaagcgtcagtggagaaagacgttagatgaagtcattgtacctttggatgacgagctgagataaagtctatataggccaactactgcgaatcttgagttggcctattctgtttattataaagaaacatcatgtggttgatgacagaacgactatgcgtactagtcgttttctttaatcaccttttccaatctctcaacctcaccccgaatcccaatcccaggctcccacgaatcaatcagacgaatggccttttgattcgattccatcgctttcgtattttctcctttacgatacaacagctgtgccattccgtaatgatagtagatcagttcaacttgattggcgttgtgtttgtcatagagcatttgttcaaaggctttttccgcttttttgagctgatcacacttcacgtaagccatgcccaggttgaaataggcttctattgttttttcgccgccgtatgcggcgctggttgtgtttgccgcttcgtataatgtgatggcttcttcgtagtgagagcgggcgaaactcaggtcgccgcggaccagtagaaccctgtgccggataatgggggagacgggctgatctttgatgccgtccagcattgctgccgctttgtccggttctccggtttttaacagcaccctcgattgcagggcgattccccatactttcaagtcgtcgtgatccggcgcgcctgattgttcgagtatcttcaggccggcttctatttgcctgagggctccgtctgaatcgttgacttccatcagcgcccagcctgccgtgtcgatcctgaagtaggcttcccgcgtgtgttcgcctgattgacgggcggcatcggctgcttttaatccgtattcgattcgcaggggcaggttgattctgcttagaaaatggctgatgcggatgatgagtttgatcaggatgtcatgttgtccggtttcactcgaccattcgatgacctttaggatgttcggccattcctttttcatttgctctaaattccgtcccagcagatagctccaatagacagaattgggctgttcccgctttatatgggtttccgcataatcaatataatattgcgcccagcggctgcgggcttcttttgcaaattcgtgattttcggataagtgctgttctccgtaagcgacaacggtttgatgggctgcatattgaattcttccttcgcttcgttctggctgtattaaagcatatgacctcatttgctcaatcgcgtaatgaaaccgccggacgtctaatccggccgcttgagccaagcttttttcatcagggggcttagcgaaaaagcaaagcgtctgccatagtttccgtgtgtcttcatgacatctgtcccatgtgcggccaaagagaacttcaaacaattccaataatgagtaacccgcttgtttaagctcttgtatgagctggggagcggggatgtcgtcgtctgacatgtatgcaatgctcagtgccatggccttcgggttgccggcggctgccgagatgaattcattcttaaggtcaggcgatagccgcagcagctgctccagcttttcccgtttttgcgggaggttgcatgtttgcagacagcggtgcacttcttgatggaaaaattcaagggcatccgtttgttcaaggccgctcagctggatggccgccagttccccgaggccgtcccggtatgtctgttttacgttttcccgtgccgtaaggagaacttttacgccttccggaagaccgatgataaattcgtgaatgtcatgttccgctgtatcaatgctgtcaacgatcagcaataccggtttttcgtttgaatgagcggctaatgcattacggacgacgaaccgtttttcgttgatggatttgtcgatttgttctgcgcgtccgagctgataggcgatcgtgtttaaaaaatcgctgaagctcaatcctttccagtcagcgctgatccaaatgatgctgttgaatgcaggccaatctggtgaaccgccggcacaaaggtaggctgcttcaagagcgattgttgtttttcccatgccggcccagcctgtgattaaacagaccggtgacggagacagcatccattgccggatcgcctctatatcaaagccgcgtccgataaagttcccggtccggcgtgacggtaagttatgcgtgacgggctgttctgtaagcgcattcgtttcatggccgggtctgtcatgaaacagccgctttactgctttttcaacatcttcatcagtcggcgctccgaatgatccgtctttccggcgtatttttgctttttttagacaagacgccgtccaaacgggcaatgcgggtttgatgacgggaatggtggtggtttccagaaggccggtcagccattcaggatccatgtcagtcttttcgataatgatccagatcatgccgaacagctttccgtcgtcaattcgtccgggaatgtagtttgcgcccatctgtccgatccagcttttgatcgtattagaggaaacgcctattcggagtgcgatttgatcgatataagactgtcctgttttttcgttctttttccttctgactttataatcaggatgaagtttcagcgatttgacggcaggtgccagcagttctgcaaattgtgtccggttttctagttcagccattagcctgcacctcctattagtactattttatcaattcagtgttttttgtatatgaaaaaataaaaagtacagtgcggctgtccttttatacagcaggaaaggctgttgaacgtatggaaaagcagataaaataggggaagtaatagagaaaacaaaaatgtatgcacttacatttcagagcagagaaaggattttgccaaatgactcacacagtgcctcaaaacatgaaagcggcggttatgcacagcacgagagaaatcaaaatcgaaacattgcccgtgcctgacatcaatcatgatgaagtgttgattaaggtgatggctgtcggaatttgcggatctgatctgcattactatacaaatggcagaataggcaattatgtagtggaaaaaccatttatcctcggtcatgaatgcgcgggagaaattgccgacgtcggatcgtctgtcgatcaatttaaaataggagaccgggtcgccgtcgaacccggtgtcacatgcgggcgctgtgaagcgtgcaaagaagggcgttataatctttgcccggatgtacagtttttggcgacaccgccggttgacggcgcgtttgtccaatatatcaaaatgcgccaggactttgttttttcgattccggattcactttcctatgaagatgcggctttgatcgaaccgttttctgtcggcattcatgcggccgcgagaacgaagcttcagcccggttccacggttgcgatcatgggcatgggtcctgtggggctgatggccgttgcggcagcgaaagcatacggggcaggcacaatcattgtgaccgacttggagccgctgcggttagatgccgcgaaaaaaatgggcgcgacgcatgtcatcaatgtccgggaaaaggatgccggtgaagaaatcaaaacgatcacgaatggcagaggcgttgatgctgcctgggaaacagcggggaatccggcggcattgcaagccgcactggcttccgtgcgccggggcggaaaactggcgattgtcggtttgccttctcagaacgagatcccgctcaatgtgccgtttattgcggataacgagattgatatatacggaatcttccgttatgcgaatacgtatccgaagggaattgaatttctcgcttccggcatagtggacacgaagcatcttgtaacggaccaatatccgctggagaagacgcaagaggcgatggaacgcgcctttcaatacaaaaatgaatgcttaaaagtgatggtgtatccaaatcgctgagtgaacggggaggatctttgcattctccctcttgcttatcaaaaatgaaaacggattcttggggtgggaaatgatgattgaaacagaaaaagcagcggcagtaaagacgaaacatcgcggcctgtcctggatggaacggatcggctacggattcggcgatatgtcgtacaatattatctttcagtttgtaaacgcatacttattattctactatacagatgtcggcggcattaagcctgcggtcatcgcagctttgtttcttatcgtaagggtgctggacgctatttttgacccgattatgggcgtgattctagacaagacgaatacaagatggggaaaggcaaggccgtatcttttgtgggtggcgtttccttttgcgttatttacgttcttatgctttacgactcctcatttcggcgagacagggaacatggtttatgcgtacatcacttatattctgcttgggatgtccttcagcatgcagacgattccggtcaacagcttaacgggtcggatgacgaattctgtggaggaacggacggttctgacgacgacccggatgattttggtttatatcggaattctgttgtcgatttcctgtgcgacaccgcttgcggacgccatcggcgggaaagatcaggcgttcggattccagatgacggcgcttatctatgcggcggtgagcatcgcattgaatctgttcagcttctttaccgtgcgggaacggattcagcctgaaaaaagaaaaaaacaaggaatgaaaaagacgttgtctgttttgttccgaaacaagcctttgctcattttggtttcttcatttttagcttttgcgatcgggtttaacattaagctcagcacgatggtgtactattttacgtataacgtcagccataaggaatttgtgtttttaggaaccgtgctgtttttcggcgcagcgctgatcagcaacctgtttattcctttcttttctaagaagcggggccggaagcaggtcatgatcatcacggcggcgttatcgctgatttcttatgcgggccttcagtttacatcttattcctcgattccccttattttcttttggcttttcgtttcgggatttttcacgacgcctttaaatacgcttgcttggggaatggttgccgattgtgtcgattatgcggaatggaaaaccggagtccgggctgatggcgtggtgatttcgagcatgagtttcatcaataagctcggagttgcgttagcggggtcattttcggcggtttatctcggaatcgccggatatgccgcgaataccgatcagaccgcctcgtcattgaatgcgattaaaaatatgaatgcgctcattccgggattgttcattctgctgtctattattcttatttctttttatcctttaactgaaaaaaatatcagcagatgatgtctgatctgaagcaaagggctgccagataagtatacgtaaaatttaaaatattctatgtaaacggttgtatttatgacagaaagcactatactgaaactataatcgagaattgataaatgagtgtgataatgtgggaagccaatctgttatttgtattggagaattgttaattgatttcttttgtaccgatgtggatgttgatttgacggaagggcgcaatttcttaaaaagtgccggcggcgcaccggcgaatgtgtcggcagccattgctaagctgggcggagacgcggctttcagcggaaaaacaggcaaagatccgttcgggtactttctgaagcagacattggacgccgtacatgtcgatacgtctatgctcgtcatggatgagaaagcgcctacaacgcttgcgtttgtttcattaaaacaaaacggggagcgcgactttgtgtttaacagaggagcggacgctttgtttacgcttgatgatattgatctggaaaaggtaaacgatgcgaaaatccttcatttcggatcagcgacggcattgttatctgatccgttttgctcggcctatttacggctgatgtcgattgcgaaagacaatggacagtttatttccttcgatcctaactaccgtgaggatttatggaaaggaagagtttcagagtttataaacaccgcaaaaaaagccattgccgtaagtgattttgtgaaagtcagtgacgaagagcttgagatcatcagcggtgcgaaggatcataaagaaggcgctgcggttcttcatgagcttggggccggtattgtggcggtgacactagggaaaagcgggacccttctttcaaatgggaaggatattgacatcattccgagcattccggtgacatcaatagactcaacgggagcgggcgatgcgtttgtcggcgcggcgctgtatcagctggcgcgcacggatgaggttcagacggcagccgaagattttgcgaagctgcgtgatattgtctcatttgccaataaggcgggggcgctcgtgtgcaccaaaatcggtgcgattgatgctttgccgagcttaaaagaggttgaagtatcactgtaaagtatggaggatgtttcttgaaagtcatcggacttcgggaagcatcctctttatttaggtctgaaacccttttcgatatacggtatactttagaaaggcatccagtaaattgaaccgctgtgaagtacatacaataatgtttttatcagttctgagtaaaaccaagtttctgctgctatcgtcatgtacagtgtgacggcctgtgatattgaaccgcggaggaatgttttttatgaaacatgtttttcttattgtgcaatgcgcgttttctgttttttgttttctttgtctcgccgctgtcaattggtatcaggggagtgagcttgtttctgactcgtttgattggaatgatacggctaaattctcaaagcttttgaatgggacggatacgattacaagtccggaacagatttcgcagctggatttctttgtgtatgcggcgaagcattatccgttagtgagcgggttgatgatcgggctgtttgtttattctttgttctcactgtatctgctcgtgaagaatttccgccggcacaaatgggctgaatgagactattttcatataaaaatacataaattcaagagaaaatgaaacctttttcgaaaaaaacagtatatataactgtgaacttgttactatttaattttgggaggaaaatgaaaaatgagtattttaggaagatttaaagacattatgtcaagcaatatcaatgcgctgctggataaagctgaaaaccctgaaaaaatggttgatcaatatttacggaatctgaacagtgatttaggaaaagtgaaagcggagacggcttctgtcatggctgaggaacagcgggcgaaaagagcattaacagaatgccaggctgatgccgaaaagatggaaagttatgcgatgaaagcgttgcaggccggcaatgaagccgatgcgcggacatttttggaaaggaaaacggctgttgaatcaagactgactgagctgcaagcggcttatcagctcgcttcttccaacgcgtctcaaatgcgcaaaatgcatgacaagcttgtcgctgatatcggagagcttgagtcgcgaagaaatgccatcaaagcgaagtggtctgtggcaaaaacgcaggagagaatgaacaaattggggtcctctgtgtcaaatgcgggccaatcgctgacagctttcggcagaatggaagacaaggtcaaccgggcgcttgatcacgccaatgcgatggctgagctgaacgcgtctccgaaagacgatattgacgagctgacggctaaatatgacagcaatcaaagcagtgtcgacgatgagttggcggcgcttaagcagaaaatgcttttcagtaaagatcaatagacagcgggctgcagctttgtccgatataaagagaaagtgagagaaacagaatgatcatttcttataaatgcccgaactgcggcgatgatatggtctttgacagttcatccggcatgctgacatgtcacagctgcgggcggcaggatcagattgaaagcctgccaaaagagtatataacaacgagattttccgaaaatgaggcgaacgagtaccgctgtgagaactgcggcgcggtattaatgactgaggcggaaacgacggccacgacgtgcgggttttgcggaggagccgccgttctcgccgaccgattatcgggaaatctcgcgccttcgatggtgattccttttacgatcagtaaagaagaagccatgagcgcttttaaaaagtggtgccgaaacggccgtctgacaccgaaaggatttatgactgccgatcgggtgaagagcataaccggcatgtacgtgccgttttggatgtttgacttaaacagcaaggttcaggtcaatgccgtttgtacgagagtgcatcactatgaagatggagaataccgggtgacggagaccgagtattacaacgcgtaccgcgatatcaatcttgattatctcaaaattccggtcgacgcttcagaaaaaatgaatgatgaattaatggacaaattggagccttactcatacagtgagctgaaggagtttaatacggcctatttagcgggatatatagcggaaaagtacaattataccgatgacgatctctttccgcgggcgaaggataaaatcagccattatattgattcttatatcagatccaccttctccgggtatacgacggctgacattacggatgagcagattcagaccgataaaatcagcagcttttacgtactgcttccggtctggatggtcagctacgactatgagcgggctgagcacatttttgcgatgaacgggcagacgggcaaggttgtcggcaaaccgccgatcagtgccggaaaagtggccgcgtggttcggcggcataaccgccggtgcgtttttagcattaagactcgtctcacttatgataggaggcggtttttgatgaaagtatcgataaaaaaagcgtgtctcttctgcttcgtcctttttctgatgctgtctttttctttacatacatcggcgtctgccgcggaacagaagcaatatgtttatgacaatgctcatttattaacgaaggatgaaacgaagaaacttgaggaattggccgggaagctgggagaaaagcgccataccgattttatcattcttaccgcaaacggaacgggcggtaaggagatcgaacagtatgccggtgatttttatgacagtcattttagcggaagcacggcgatattgactattgatatgaaggatcgggaagtatttctctccggatataaaaaggcggagacgtatttgaacagcagccggctgaatacgatcagaaatacgatctcgtcagatatttccgcaggccattatgaaaaggcgtttcagacttacatcaagatggcttataaagatatggggaaaagtccggacgacaagtctgacaatctgctgctcacatggtggtttcagctgattatcgctgcagcagcggccggaatcgccgtcaccgtgatggtgtacaattccggcggcaaggtcaccgtcaccggcagcacgtatatggatcacgatacgtctgaagtgctgagccagcacgacacatatatccgaaccgacattacaagagaaaaaaagccagataaagataatgacaatgacggcggagtcacgaggggcggcacgagttacagcggaagcaagggaagtttttaaattatatgtaaaggatttgagcatacatgggttttttcagaaatcagttagcaaatgtggtggaatgggaagaattcagagacgacatggttttctataaatggaacaaccgtgaaattaaaaaaggcagccgtctgatcatccggccgggacaggatgccatctttttatacaacgggaagattgaagggattttccgtgatgacggcgattatgatatcgaatcagaaatcattccgtttctatcgacattaaaagggtttaagtttggctttaacagcggcatgcgggcggaagtgctgtttgtgaatacgaaggagttcaccgtgaagtggggcacaaaaaacgccatcaacattccggcggcaggtatgccgggcggtatgccgatccgcgcaaacggcacatttaacttcaaggtcattgactatatcggattgattgataagattgcgggtgtcaaagacagctatttagtggaggacattaaaatccggattacgtctattctcgatcagcttttgatgaaatggatcaccagagaaggaaaagacatgttcaatctgcagtcgaattcatttgaaatcggaaaagggattcaagaagatcttgatatgcagctgatcggagacggcatgtcgattacgggattcaatattatgagctttaactatccgcaggaagttcaggatatgattacgaaaaacgcttcttacggcatggtgggggatgtgaaccgctatcagcagatttccatgacggacggcatgtcatccggcaaaatgagcggaagcggcgccgcctcagacatggcgggcatgatgatgggaatgaatgtggcaaatcaaatgatgaaccaaatgaatcaaaatcagcagaaccagccgcagcaaaatcaaagtcagcagaatcaggggacggcgccggcaaacagctcggaaggagcggctaagccgaaattctgtccgaactgcggaacgaaaacggaaggcgcgaatttttgcccgaattgcggacagaagcttgcctgacgatatacgaaaaagaggccttttttgggcctctttttttgtcatgatttcattgtttgaacgatgagggatgtcagcgcttttgatccctcaggtatgagatggacgccgtccggtgtgaagtattcagggtgctgcaatgcttttgcgtgccaatcgacaagggtcacatttttgcgtgactcggcctgccggcgcaatgattcgtttactttgctttcccactgccgcggtacacgcgtgttgacaagatagatatcggcttttgaaaaggagctgatcagtgattcaatttggctgtttgtgaaatagccattcgtccctaactcgatgatgaccgctttgttcggctgattaaatgacgcatattccgaagtgagctggagtgcttgagagacttgtcttcctacctttccgtcgatggtgacatgagggagggactgccgcaggtatgacgcaatgtccagcatcaccgagtcaccgatggccagcacgtcttgctgaggctgtgtttgttttgaatcagcctttttttgagatgaccgttcctttttctcgtcggttttcttcgtttctgatttgtctgctggttctttcttgtttttgtctgacgcggtatccgttttttcgccgccgtgttttttcttgctgtcttcttcttttgcaggctgatcgtgatcggccgttttgtgcgaagaggcggctgtttcttgctgatcactctgcgcgtacgtccattgcggctgttttttctcttcggctatccctgacagcccgcctgcaaatacgagaatggcggcaagaatgagaccgagcgacattctgctgatgacagaggacgtcttccattccagaaagcggttcagaaacacgcggcgtaaaaatggccggaagcccgcagtgcggatcggctgttcaatgaaatggtaagatagctcggcgagaatgaaagtggcgccgattctgacggcgcagtgccaataaaccggatttccgatttcctgcacgggtgtgctcagtacgaaaaccgggtaatgccaaaggtagattccgtatgatctcgttccgatccagcgaagcggtttccatgaaagaacatgtcccaaaaagctgctgggatggcataaacatgcgacaagaaccgctgcggtgatgctgatcaaaagcatgccgcccttgtacaggaagggttcatattcatccgtgtaaaagacgcaaagcagcagcgcggcaaaagcggcaagctccgtcccgtgaagcaggtgtttcatgctgctcggcagccgtttggaagataatcgtttcatcggccacactaaagctaaagcgcagccgatcagcaattcaaatgaccgggtatccgtcccgtaataaacgcggctcggatctccgccgggcacatacaacatactcattacgactgccgaacataatgcgaggaacatgactgcggccgcaagccgggcccgtgttttacatatgtacattcccgcaagcagcaggaagggccatatgatataaaactgttcttcaatcgccagcgaccaaaggttttttaatggcgaaggggagccgaagctgtcgaaataagaaagttgatgaaagataaaccaccaattgcttatgtaaaaaagtgaggagaccgcatctccgcgtacggtatgcaggagctcgctgttaaacaatacgacccaaatgaccgtcgtgataatcatgagataagccgccggcagaagccgtctgatccggcgtacccaaaaatcacgcaaatcaagggtgatgttattgccctgggcaggcaatataatagatgtaattaaataccccgataaaacaaaaaagatatcaacaccaatgaaaccgccgtcggcccagttaaaattcagatgatatgcgataactgcgaggacggcaaaggcgcgaagtccatccagtccgggaatatagcggtgatgcagtgacttgtctgacatggtattcctccaataatgtgtgcggaaattcttgctgttttgcggatagctatagctgatttctgtacagtcttccatttgttccgttaattagacgcattcggaaggggattttgtttcagaaaaaatgtatgaaatgctgtgattttcttaaacttttcagttcccgtccggcgtctgttatatgaaaagggtcccttatgcatcttggctgttgcgggacgaaagaaaaaatccatgatctgcggatatcatggatttttttctttctttatctgatgtagcggtctccgacaagcagcttggagatgacggaggtcggtattgtaaactctgtaacgcccatatatccgggtgccgcttcgtattcatcaaatgaaataacaagtttatgcttatctgtaatataaaaattctggtcggcgcggatggctttaaaaggctccgtcatatcatcttcttcgacccagtatattttattcggatcttctttcatctgttttttcatttgttctttaatattttcgctgatgactttaatataacggtcatctttaaataaactctttaacgtaagcacggcctcattctttttatcaatcgtgatgtaacggctttgcgtataagatgaagcttgcgttttttcgatatcacggcggattgagatcagatccgctgtgtcagtaacggtttcataatcgctgtaaatactgaggtggccttttttgctttttgaggtcgccttcataaattcctgatacagctctttgctttctttcatataatgccggttgatgctgtcttcgagtttatgatcggaaagtccggacagagcgggcgttttcacatcaatgcttgattggttcttttcttccttcatctccgtgaatgtgatggcttggacgactttgccgatgacggggattttagacatggcttgtgcggcatccgggttgatattgacaacggcggtaaataagacggccgcagcgactgccgcggatgtcggccacatcacgattcgttttttcttcggtttttgctgaagggctttttcgacaatgctgtccagttccttaggaatgggcacacttttatactcttctcttaattgttctaatctcttttccattaagaaagatcctccttcgtcagctgaatgcgcatgagcttcagccccctgtaaaggcgtgttttgacggtgttgatgttttcccccgtgatgtccgcgatttcttctaatttcaggtcttcaaagaaacgcagaatgataatggttttatattgatgcggcaggtcatcaagcgcttcgtgaaggtctgtgtctttgtagtgatcttcctttcctcggcttaaaaactcgatcgtttcatcatccatcactttcagttttttctgtttgcggagaaaatcaatggccgtgcgcactaaaattttataaaaccagcttttgatcacatcggggtttttgacggattcgaccgatgtcagcgctttttgaattgattcctgaacaatatctaacgcgtcatccttgttctttacgtaactgtacgcaagccggtaaaagtcttccttgcgctcagttatgcacgtcacaagcgacgctttggctgtttcgttcttcattgcttcaaagggctcctttttaaaaaatacgtatcataggctgctgcctaaggatagacgggacagggtgaaaaatagtttgcgcagaggggatcatttttaaaaggaaaaggaaggaaagacgatgagatgaaaaaaagagccggaacggctctttttcggatgtgtctgatattcagctgaacggtttagttcggtttgactaagattttcacttggtttttctctttgattaaagcgccgaagccttcttcaatcagatcgtcgagcacgatttttttcgtgacgagcttatctgctgagaagtagccctctttcatcagtgcaagaacggaagggaagatgtcgcggtatccgataatcccttttacggtccgttctttgatgacgatatcgttcggatgaatttccgctcctttttcccagatgctgacgataaccgtttcaccggcaatgtttgttgactggatcgcctggcggagaacgacaggaacgcctgttacttcataagaaacatcaacgccgccgtttgtgcgtttagcgatttcttcaacgacatcgtccgtttttgacggatcaatgatgatagcgccgagttctttcgctttttcctgacgttccggtgaaagttcaaccgcgtaaatatctgtggcgccggccgctttcagggcttcaattacaagcagcccgatcggtccgcagccaaaaactgccgccttgtcgcccgcttttaatttgctttggcggacggcgtaaagcgctaccgctgacggctcaacaagcgcgccctgttcgtaagaaagctcttcaggaagcttaaacagcaattcttcgtcaacggatacatattcagaaaatccgccgccgcctccggctaagcctaagaatcccatttgttcatcaaggttataggctccctgatgtccgtgtgtggcaaaaatcggttccacgacgacacggtcgccgacgctgtaatttttgacgccttcgcccacttccacgacttctcctgagaattcgtgacccatcgtgacgggcgccatttcgttagttaacggatgaggttcgccgaccggaataaagatcgggcctcccaaatattcatgaaggtcgcttccgcaaatcccgcaccatttgactttaattttgactttacccggttctgctttaggttcatcaatgttttcgattcgaatgtctttttgattgtgccatcttgccgctttcattgattatcactcctagtctgattgaaacgagtataggtacatgatcaatatgaaccacggttaaaaggaataaagtgcttcctaaagcctgatttctcaaaatatatcatattatgcaactatcaataggccttataaaaagtccatattgaatgcagaaatactctatgaatattataacgctaatgaattaaattttgtagtataatttaccatggaattatatagaacaggtaattgtgccgtcgttatgtgcatgtctcgtcacgttgtaatgaacatgtaaagtgattgaaatattataatcgtcttcttggtgtataattttgcctagaataaagaatcaggaggacgaaagcttgaagaagttattcttagccttattgattttagcaggaagcacgctgggagcgatcagtttctcttctgatgcaagtgctaaaaaagtgaacggaaatattacatggtataatggagtcggtaaaaaaggatcttccggtaaaaaactgggacactgggattgcgcgacaaaattaggatttgacgttccgagaaacggaacgaaaatcagagcttatgcgaaagcaaaaccaaaaaaggttatcacagtatacaaaaatgatgtaggccgtctgccgaatgccgtattggatgtcagcccgaaagcgttcaaagcgctcggatatccgttaagcaaaggaagagtatccggacactacagctattaaaatagaccatcttaaaaagcaaggactctgattcttgctttttctgattgacggagagattgataatgaagaagaaacgatggatctggatgttgctggccgccgttttggcggcggcggttatcgcgtccgttttactgattaaaggaaaaagcgacggcggcggaaaagccgttgtctccggcggccatgacaagctgcttgtttccattacagacaaagatctgatgacgaaatattacgaggacgaccgcgtgctgtacgaggaaaagctttcggcatatccggcgtttgcactggatgacgcccatcaggtgctctattttgtcgggaataatgaccaaaatgagatgcgtctgtataagcttgagctgaagacgaagaagaagacggtgctttataaaggaacggcaagcgctgacagtctgtttttatcaaaggatctgacgcacatttatttccgtctcggaaaagcggatgaagacattttccgtctcgcatcttttgatttgaaaacgaaacgttatgaaaatctgtatcctgccgccgatgagaaagacgacagtgtaagcagcttcttttataaccgcagccaaaacgattttgcgcttctgcattattccgtaaaagaggattatcaaaaaacggatgaggcaaatgagaaggggattgaccctgaaccgacgaatatccgatttgcagcaggagagggcgaacaccttcaggacctgacaaaccttgaacagtttatcagcggcgtggcggtgtcaccggacggtaagaaccttgtctttacatcttatacacaaaaagggacggaacaaaaagcgtccatccgtctgatgaatgtcaaaacgaaaaaagatgaaacgattatctcaaacgggaaggatttcgctccgctgattgatgcccagcctcagttttctaaagacggcagcatcatttatttcatggcggaagcaaaaggcgctaagcgactgaaggatgaaacggggcggaatgcgaaggtccggaccatttatgcttatcatttggatacgaaaaaatgcgaaaaagtctgggaaaatgaccacggcattatcaatagtttttccgtcatccaatcatgaaaaaaacactcagcgcccgctgggtgttttttaatgaacaaagctggctgcggctgaggcgagccatttgaaaaaacggagaatcggaacggcaaaatgaagcgtttcgatgaatgactgtgcggcaaggttcattttccgccgttttgccatttccttcagatctttctgctgccgatcgtttttcatgttcattgctcctttgcatcataaaaggacatgataacgcaaaggcctctcatgagacatggaggccttctctatgttgagactcgtaaaagggaggtctaacttgatgccgtttgattattgttttggagatttaccaacgaacggacgccgtcgatcattttactgccgcaaagggggcaagtcggggtatcactgccggcaaaattctttctgctccagccgatacagtcctcttttgtgcattcccacgtactgacatcttctttaggcagcggttcctgattacgtttgttgtagtaagacataaagtcacttcttcccttatgaattttcgtgcactccttcattgtctcatacttttccctaatctcctaattcctttttctatccagatttccaatgagggtgcatcgtcttcctgttattacagtatatgcaaaaaagcgccttcttattttttctttttggataaataaaaaaagccccttctggagaaagggggggatgtttgtttactgcttatccgtgacgtccatcggtctcatcatgtcgtaatcttcgtgctctaaaatatgacagtgccatacgtagcgtccgctgtaaggagcgaaagtcgccgcgattctgatgacttcccccgagtgcgcctgcacggtgtctttccagcctttttcacttggaggaggcgggacggcggggcctgtatacacaatgtcgccgaatttgttataacgctctaagtcaaagggacgccggtcaaggatttggaaggaaacaaggtgcaggtgtatcggatgggttccccccatcggattgataatcgaccagatttccgttgcgccgagcttcggcgcttctgtcacaggatcatgccatcgcttgttattcagcgtcaaaacgggccggccgtatttgtcttgcgtatttgtgagtttcagtgtcctgatgttgtgtattctttttgatgttacattaggcattgttgaaagatatttaggcttccggcttgtgtcttctcccttcagcggttttgtgacgcggaattgcatcacattggcgtctgtatccggatcgacgtcgcccccgcagccggtgccgttcgttaaaatgatatgttctccgtcaaaggcggagaaatcgatgagcacatcataccgctcggccggggctaagctgatagattgtgttttgacagagcggggaagcagtccgccgtcagaaccgatttggataaacttcccgccgttattgagcgagagagaaaatgttctcgtattggaggcattaaggatgcggaaacgatatgtccgcggttcaacttccatatacggccacgctttaccattgacgagaatggtatttccgcaaaaaaacgggacgatggaagggtcgggcagcgtttcggaaggattagcaggtccgcttggataagacaaggaaccgtcgtcatttaacgtgcggtccaaaatcataagcggtacgtcgtactctccggagggaagcttcagctgcttttcttttcgctcgcggatgatatacatcccggcaagcccggcgtacacattgagcctcgtaatcgccatggcgtgatcgtgataccataacagagccccgcgctgtttgtttggataatggtatacctctttctcaaaataaggacccgtttccttaaaatcctttgtgaaccaggcttccgggtagccgtcgctgtccggcggcgttgctcctccgtgtaaatggacgacggttttgacatcgggttcctgatggccgctttctgaatggtgaatggtatgatccacgggcagaaagtgcttatccggcaggtcattcatccatttaatatagacgttttcatctttgttcacgtcgatcgtcgggccgggaaacaaaccgttatacccccaaagccgggtcggcgggagatcgcggtgcagcttgtgaaagcattccttcatggtgacttcataatacgtgctgccgtctgatttcttctgcggctggagtgtttcgataatcggcagttcatctgcaaatttttctagtgccatttttcatcctgtccttatcatttattgaaatcctgtactacagttaatgctgcctggaacaggttggttaaaaaaacacccgcccttttttgagaggggggtgtttgcggttattgcgcaacacggctttcggaagcgctctctttcggtttttgttttttgcggaatacatatgaggcaagtaccagcagagtaataaatcctgtcagcagaaattcagaacgcattgaactgataaacagcatagataacaagatggcgcaaatggcgatgatcgtcaggtaggttaagtacggatagaaccacattttgattttaagagattcagggtttgtccgttcgattttctttctcattctcagatgtgagacggcgatgacgagatagacgagcagtgcgatcgcccctgatgaattgaccaggaacaaaaatacggagtcgggagaaaagtagttcataacaacggcaatgtaggagaaaaaggtgccggcgataatggcttgaaccggtacgcctcttttactcagtttcataaaacgccgcggcgcttcatttcgctctgccagtgaatacagcatccgtgacgtcgtataaagcccggagttcaggcaggacagaacggctgtcaggacgatgaaattcatgatttgagcggctgcgggaaccccgatatggctcaaaacggcaacgaaggggctctccaaaatattggctgaatcccatggcagcagtgtgaccacaaccgcaatggagccgacgtaaaaaataatgatccgccaaacgactgagcgggtcgcctttgtgacggattcgaccggatttgacgtttctcccgctgcgattgcgacgatttcagatcccatgaaagaaaaaatgacaacggcgataccgagcagaacggaacttggacctttagggaaaaatccgccgctgcccgccagattttccagcccgaccggcttgctgccgggaacgattccgaaaatgaacgcaaatcccgcgattaagaagacaacgatcgtcgctaccttcactaaggaaagccagtattcaaattcgccgaacgatttaactgaataaatattcgtcagtgttaacagcacggtcagaagcagactcgtcagccataacggaatgcccgggaaccagtactgtatgattccggcgcctgcaatggcttcaatggcaatgacgatgacccagaaaaaccaatacagccatccgatcgtaaaaccggcccaaggaccgatggcgtcatgcgcgtactgtgaaaacgaaccgcttgtcgggttgacggaggacatttcccccagcattctcataataaaaatcactaataatcctgctaaagcgtaggagacaatcgctccgggtccggtggaatgaatgactgatccgcttccgacaaataatccggcgccgatcacgccggcaattgaaatcatggtcatatgccgggtttttaatcccttagataaagagttaggctgattcattctttgcctccttttggtttgtttatgctgaatattccgacaagtattattctatcataaatgccacagacagttgaaaatgatgtaagaaaatatgacatttttttctcatccgtacagcagtagtgccgggatgaaagaggaacatgccattgaccattcacacgttcatatggagcctctccagctgaaataaagcttcctttctaaagggagcttttttcctttttcggactggaaacaattcgctggaaacgtttttttatactgtttatattttgtggtaaagttaggttacgataattgaaatttgagagatgactaggaggagaagaatggcttataaagaagagctgcatccgctgctggagaaagccgttgagcatattgaaaacatcatcataggaaaacgggatatcgccatactcagtctggccgccattctcgcaaaagggcatgtgctgctggaagacgtgccgggagtcggaaaaacgatgatggtccgggctttggccaagctgatcggagctgactttaagaggattcagttcacgccggatcttctgccgtcagatgtgacgggtgtctctatttataatacgaaaacaatggaatttgaataccgcccgggaccgatcatggggaatatcgtgctggctgatgaaattaacagaacctctccgaaaacgcagtcttccctgcttgaggcgatggaggaagggaatgtcacgattgacggaaagacaatgcggctggctgagccgtttttcgtcatggccacacaaaacccggttgaatatgaaggaacgtatccgcttcccgaagcccagcttgaccggtttttatttaagctgcgcatgggctacccgactgccgaggaggagcttcgggttctgtctttgcaggaagggcgcaatccgcttgaaacaatcgagcccgtcatttctaaagaacagttcatcaccctccagcaaaaactggagcaggtgcgggtggatgatggaattaaagcgtatatcgtcggcattactcagcatacccgccggcatccgtccgtacatctgggcgtcagcccgcgcggttcaatttcattaatgaaagccgcgcaggcgtacgcgctgcttcatgaccgcgattacgtcattcctgatgacgtccagtatttggctccgtatacgctgccgcacagaatgatcttgaccgccgaggcgaaatttaacgatgtgacgccggaagcggttatagaagacatcatgcaaacggaaaaagttcccgttcaaaggatgtcggtccgctaatgagaaagaagatgcattggcttctatatggctggaagctgcttatgttggccgtactgacggcggctgtcttttcttatgccatgtttcagggcggatttgtgagctggtttttattttatgcgtttttgccgtttaccgtttacgccgggctggtcgctgtgtacccgctgcgggcgtttcaggtggcgcgtgacgtgtcctccgcccagttaacctcaggcgacaggctgtctgtcaccatcaggctgatgaggcgcctgccgtttccgctgacatatatggtcattgaagatgtgatgccggaaacgcttggcgagaggcgcagtgcgaaacagcttgtgtttccgtggtttcaaaggaagctgacgttacaatatgagctgccgcaggtgccgcgcggagagcatcatttacatacgatcagagtgcggacgggagatgttctggggcttttggacaagactgcgtcgttttccgtaacggatacggttcttgttttcccggcgtacgggcctgttcactataagccgcaggctgcatccggagaagagggtgcgggtgccggtgctccgtttcaggtacaccgcacagcaatggctgcgagcgtcagaaattatcagccgggcgaccggttttccgcacttgactggaaaacatcggcgcgtcgaaatgagctgatgacgaaggaatttgacccgctgcagagtatgaatatgattctccttttggactgcaggccgtccccttcgtttgaagccgcggtgtcagcttcggcatccctgctttacacggcgcttgtgaagggctctcccgcaggatttatttcattggggagcgaccggactgtatttcccgtccgggagggagagcggcatttcagacagatgctgcgttacctggcatcagcttcagagtcggaagaagccgatgcaggcgggcgtttagggaaagaactgggtaaagcttccgttgtcgtcgtgacgggcagtcttacagaagaccttctcaaacaggctgagcccggccgtgctgacatgacggtgtttttggcgaaagaaacgaatgccgcgctttcggagaaagaacggaaactcgctctcatcttcgctcagaaaaatattaaggtgcaaatgatcagggacaaacgggtgtcccatgttgtttagaaagagaggtggcgcgccatgccgcatgacgagaaccagggaagcaggctgagtctgctgctgttttattttctcgcttttttattgttatgggaatggctcaggccgctgcacaattttacggatacaaaacataccggttttttcatcgtttttatcggtttggcatttctgctgtcattcttccggatgaggtggtacgtcaccgtgccgtcctgcattctgtttacgttgatcagtattcacatcctgttttataaaggttctatttttcagccggaatggctcgtttcttttttgcgggacgtgatgcaaaatgcccgccacatcgggaccggaagatggaatgatatgaatccgtcattccgcacgttgctgttttttgtgcttttatggctgctcgtgtatttgctgcattactgggtgatctatcagcggaaaatattattcttttttatcatgacggtggcgtatatcaccgtgcttgatacgtttactccttatgatgccgcgtacgccgtcatccggatcgtctttatcggctttttgatgatggggcttttgtatatggagcgcatccggcttacggaacacatagcgtttaaaaaaagattgatactcaaatggtttctgccgctgatgctgtttatctgcgcttccgtcgtgttcggtctggcggctccgaaatcagacccgaactggccggatcccgtgccgtttctaaaaaaaatcacaaaccacaaagaagtgcccgccgccgaaagcaaaatcggctacggcaatcatgatgaaacattgggcggtccttttcaggaggatgatacgccggtttttacatggaagggaaaagaacgggcgtacttccgggtggaaacgaaagatacatacacggggaaaggctgggtggagaccgatcagggcatgtcctataaactgaacggcggcaatgtggaagatatatggtttgaccggagtgtgcagacgagacggtatacggcacaggtgtccattgatgagaattatctctataatcacgtcatgtatccgatcggcgtctccaatattaaaccgaagcactcgattcagcttgaaatgaacggaaacaccgagcaaattacgccggtcagtgaacaagtgggcaacatccgcaatatgggacggtacacggtgacttttcaggcgcccgtctttaagctgaatgatctcagaaaagtgaaagtgaaacgataccgtgagcagaatcaattcaatgaccggtatttacaggtccccgacagccttccgaaaagagtgcgacagcttgcggacagattgacgcgggatcatcataatatgttcgataaagcgaaggcgatcgaggattatctcggatcttccgcattttcgtataatacacaggatgtcgcggttccggagcacagtcaggattatgtcgatcaatttctgtttgaaacgaaaagaggatattgtgataacttttcatcggcaatggccgtgctgctccgctctgcgggaattcccgcccgttgggtgaagggctatacatccggtgaatataaaggggcaggcgaccataacggccacatttatgaagtcacaaacaacaacgcccattcgtgggtagaagtgtattttcccgatcagggctgggtgacgtttgagccgacaaaaggcttcaccaatccgacggagtttacgtcagagcaaaatcataccgcggcaaaagacagcggaggctcagcggggaattcggattcaccgtctaacaagcagcgtcaggaaacaaagccggaaaaagaagaaacaccgaaaaagcgggatcacagcgcggcaccgcagcctgtgatccgcaacaaaaccgcggcacacctgtggccgtatgcagccatcgtcatcgtaatttcagccgcggcggcactcgcctggctgttccgggcgcgctggattccgcacgttacagcagccagattgaagcggcaaacggatgaagacgtctttttcgacgcatatgccgcgctgctccgccagctgaaacgaaaagggttcagcaggggagacggagaaacgctccgcgattttgccgcaagggttgatgaggcgcaccatacaaacgacatgtccgagctgacgctgcgctatgagcgtgctttataccgcagcgataatgccgcaaagctttggaatgaatcgggacagttgtgggaaaatataattaaaagaagatagtcttgaccgcatatcgtcctgttgttagaatatatgaatgttaaatgggagcccgggagcgttaaaaagccgggcttccggacaagtcttgccgacagagggctgaacgtgtgtcctccgttttttctgtgtcaaaaacttagaggagattaggtgacaaccatgacgaagttagtgaatgaaatgattcttgttcttgatttcggcagtcagtataaccagctgattacccgccggatccgtgaatttggcgtatatagcgagctgcatccccatacgttgacagctgaggaaatcaaagaaatgaatccaaaaggaattatcctttcaggcggaccgaacagtgtatatgatgaaggatctttccgctgtgatgaaaaaatctttgaactcgatattcctgtattgggcatctgctacggcatgcagctgatgactcattacctcggagggaaagtcgaggcggcaagccagcgcgaatacggaaaagcgaacattcagattcaaggaactccagacttgttcaaggatcttccggaagaacaagttgtctggatgagccacggcgacttagtcgtacaagtgccggaaggatttacggtagacgcgacgagccatcactgcccgaactcggcgatgagcaaaaaagacaaaaaatggtacggtgtgcagttccatccggaagtccgtcattcagaatacggaaatgaccttctgaaaaactttgtcttcgggccttgtgaatgcaaaggcgaatggtcaatggaaaactttattgaaatcgaaatgcaaaaaatccgcgaaacagtcggagacaagcaggttctttgcgcgctaagcggcggtgttgattcctctgttgtggctgctttaattcataaagcgatcggcgaccaactgacttgtattttcgtcgatcacggcctgcttcgtaaaggcgaagctgaaggcgtcatgaaaacgttcagcgaaggctttaatatgaatgtcattaaagttgatgcgaaagacagattcttaaacaagctgaaaggtgtttctgatcctgagcaaaaacgcaaaatcatcggcaacgaattcatttacgtatttgatgatgaagcggacaagctgaaaggcatcgattaccttgcgcaaggaacgctttacacggatattatcgagagcggtactgcaacggcgcaaacgatcaaatcgcatcacaatgtcggcggacttcctgaagatatgcagtttgaactgatcgagccgctgaacacccttttcaaagacgaagtgcgcgcgcttggcacagagctcggccttccggatgatatcgtatggcgtcagccgttcccgggccctggacttggcattcgcgtactcggtgaagtaacggaagaaaaacttgagatcgttcgtgaatcagacgcgattctgcgtgaagaagtggcgaaccacggccttgagcgcgacatctggcagtacttcacggttcttcctgacatccgcagcgtcggcgtcatgggagatgcgagaacgtatgattacacaatcggtatccgtgccgtaacatcaattgacggcatgacatctgactgggcgcgtatcccttgggatgtgcttgaagtgatttcgacacggatcgtcaacgaagtgaaacacatcaaccgcgtcgtgtatgacattacgagcaagccgcctgcaacgattgagtgggaataaatgaagataaaaaacgtctcttttaaaaaagaggcgttttttttcatctttttgaaaccgttttgccccgattcatatctaacagcataggaggtggataaggtgaaggaagaacgattgatcaaaaaggcgaaaaaaggtgatgccgcagcctttgaaaaactgatcacaacccatcaggagactttatataaaacagcttatctttatttgcatcacaaggaagatacactggacgctgttcaggaaacggcttacaaggcttttcttcatatcgcacagctgaaggagccgaaatattttaaaacgtggctgatccggattctgcttcatacgatttttgcgatgaggaaaaagcacggagacgtcattccgtttgagccgcagcacgacacacgcgcggagaataagaacattgaagagtacatagatcttcggaatgctctggaaacgcttgacgaacatatacagctgaccattcagctttattattttcaagatttctcgattggtatgatcgctgaacagaccggtatggcggaaggcactgtaaaaacgcatctccacagggcgagaaaagcattgaagcaggaactggaaaaggaggataaacacatatggaaaagcatcaaatgaagcaattgtatcaggacattgacgtgccgaaagctgagttgaaaaacgtgatacacagcgctgctgtccgtgccggaaaagaaggcgccgtcagacggagatggggacgaaaagtgataaacggcctcgcggttgctgctgctctgtttattctgtatctgtcctcaggcttgttcatgccctccgttaacacggctatgggaaacattcctgttgccggacaaatttacagtctgtttcaggataaggcaggttctgcgctgtttaaaagcaatttggtgacaaaactgaacgaaaaagcggaatcacgcggaatcacggtgacagtgaaaagtgtgtattacgacagcggacagctcgtttataactttatcgttgataatttgaaatcagatgaggagagcatctcttttcaagtcgattataaagatccacggaatatgttagcagaggattatgacagcagtgatatgaaaaaaatgaaagacgggcggtacgcggggcagcttcgcctgttcacggacggctcaaagctgaaagacggtgataagcttccgcttgtcattacacaaatcaaggatatccccggaaactggcgctttacactccctattaaaaaacaaaagtccgtttctcttgaaggaacgaaagctgtgaatgtaaatcacggattataccgctttttcgatatccgggcggaaaacggaacgatgggatcggccctcctgtattctatcgacttctatgatgcagccaaaaatgatgccatctcgattgacgaagcaacggatgatgctggaaaccattatgaaatgacgatgtcgaatattgaacttggcggcaggaagaatcttcccggcggcgggaaaagaatacgcggccaaactcaattcagcaaaccgatagacccgaaagcgaaaacacttttcataacgggcgatataaaaacagaatcagagccgggagaaatcgtgcctctgaaaacaaaactgcccgtcagttataaaacgaaacatcatcatgtcggcatcaccatcaaaaagatcaaacagcaagacagacgggtgattgtcgattatcaattcagcggaattgatgtaagcaaggcggatgaagatcagctgatgaatgtcggtgaatcaatcggtctcggcaatacgaaaaaaatgaaaacttggccatcgcttaatgagtatgaaaaaggctattatttgaaagggaataaggcgaaagtcacgaatcttaaaacgggtgaaatggaatccgtttttgaattagatgattcatccgataaagactattcattgcgcgatttctcattcgattcatatgctttgtacgtcaatcaaacggttatgaacttgctggcggatgacaaggggatcacattcgcggtgccggttcggcctgcggacggaaaatgatgccgggaaggcggcccttgccgtcttccatttttggtcaattaacgaataaaccaattttttttaactggattgttcgtttttttattgagttttcaaaattgaattgatacaatagactcagaaatcaaatatgcagatatcgtataatggcggggatatggcccgcaagtttctaccaagctaccgtaaatggcttgactacggatcaatctcaatcgtttgatataaataatccattcttatttattcagactgaacgtatgtagtcaagcgtcccaaatgtatttggggcgttttttatttggcggataacgggcagaataaatgggagagaatgaaggaggcaattggcttgaagcaattttttcagtttgatgagctggggacaagctatcgtaatgaaatcatcggcggtttaacgacctttttgtcaatggcgtacattctgttcgtcaatccgctgacattgtctttaaacggtgtgaaaggatttcccgaagcattaaaaattgatcagggcgcggtgttcaccgctacagccttggcgtctgcggccggctgtattttaatggggctcattgcaaagtatccgatcgcgattgcgccgggtatgggattaaatgcgttttttgccttctctgtcgtactcggcatggggatttcatggcaggctgcgctttccggcgtcttaatttccggaattatcttcgtggcgctttcgctgacgggattgcgggaaaaaatcattaatgcgattccgcctgagctgaaattggcggtcggcgcgggtatcggtttgtttatcacatttgtcggtttgcagggttcgggcattattgaagcgaactcatcgactttggtgtctatcggcaatattcacagcggccctgtgctgctgacggttttcggtgttattgtgacggtcattctgatggtgcttcgcgtaaacggcggcgtgtttatcggaatgcttttgacggcggttgccggtatgatctgcgggctgattccggttccgacacacattgtcggcagcgtgccgagtcttgcgccgactttcggacaggcgtggatgcaccttccggatatcttctccgtacaaatgctgattgtcattttaactttcctgttcgtcggatttttcgatacggccggtacgctggtagctgtagcgacacaggccgggctgatgaaggaaaacaaacttccgcgtgcgggaagagcgcttttggcggattcaacatcaatcgttatcggagccgtgctcggtacgtctacaacgacttcttatgttgaatccagctcaggcgttgcggcgggggcgcgctccggcttcgcggctgttgtgacgggcattctctttttgctggcgatgtttttctcgccgcttctgtcagttgtcaccacgaatgtgacggctccggctttaattatcgtcggcgcgctgatggtggcgccgctcggtaagatcgcctgggataaattcgaggtggctgttccggcatttttaacgatgattatgatgccgctgacgtacagtattgcgacggggattgcgatcggttttattttctacccgattacaatgatctgcaaaggaaaaggaaaaagcgttcacccgattatgtacgggctgttcgtcatctttatcctgtatttcatcttcttgaaataacggaaaaaccggctgaggaaagccggttttttgtttttgtcctattccgtaaaaccaatacataatataaaacgtcatgtgggtgtccgggtgaagaaaaccgcttgactgtttaaggccgcttcggtaccttatataagtgttttattttcttgctaaacaaattccgccgtatttttttgataggagttgctgacatgacggaagaaagaaaagaaacgttggaagaagaaaaacagcatcagggaactaatgaagaaccgctgtcgagaatgtccagaaatgcgggacgttatcaaaagcaaaagaaaaaagaaaaggaacggcgcccggctccggcttttacggaaaaactcgcttctgcatgggccgcggtcaaacgttattgccgtttcgcgctgcgcattttgacatcaccggtgaaggtcgttggggaagacggcttttcccgctttaaatatgctcttatttcaatgcttgtattcagtatctttttctcaatcggaaattggtttcagctgagggcaagccagcaaaggcctctcggatacggggagcggcatcatacgttttttgacggctttaccgtcgttctcgtgtatacgctcgtcttttttgccgctgcggccggcgcggtctggcttgtatcacgttatatgatgaagcagaaaattacgatgcgggatgcggccgcgggggtcggatcgcttttggttccggctgtcgcctgctctatcgtgtggatgattttcgcgatattgaatctgccggtcatcaccgtggtgtttacggcgctgaccttgtttctggccgcctcggcgatggtgcagtttgtgcagattctatacaaatcggctgaaaagcctgcggctgacgtgatgtactgtatttccgcggcggtcatcatcatgctcgtttttacggctgtgacatggccgctcatttccgagtactttactgcttcgctgattcctttataagtcgaaatttgtctttcacaatgtttacaaatttttctaatgaagcgtgttgttttgaggacccggccgagatatgatgagagcaacagcaattcgaaagcggcactactctttatgattcggaaagggatgatgaagatggccccgttgttgcgagaagccattaatcggaaaaaacagcacctgaggacaaaactgatccgctcagggttttatcaagaccatgttcaggaactgtccgggtacacgctgagtgaacttgagaaggaatatgaagccgtcaaacgattgaaaaaagccgagcttcactgataagagcttgaaagtctgccttgcggggcgggcttttttttcttttgaaaatgatgaaaagagggtaaactatccttaattgaaagattggcttttcaaagtcagaggaggggaatcagtgatgcagacaattttatccaacagtataggtatggttctcattattctcatcattaacattatatatgtctctttctttacgatcaggatgattctgacattaaagggacagcgctatttcgccgcaggcatcagtacaattgaaatccttgtgtatgtgaccggcctgagtcttgtgctcgacaatctgaatcaaattcaaaacgtcattgcctatgcgctcggctacggcctcggcgtcatagtgggaatgaaaattgaagaaaaactggcgctcggctacataacagtcaacgtcattacgaaggagctcgatctggacctgccgaaacagctccgggaaaaaggatacggtgttacaagctgggttgcgggcggacttgaaggagaccggaccgccatgcagattctgacgccgcgcaaatatgagcttcagctgtatgatacgattaaaacgcttgatgaaaaagcgtttatcatcgcctttgagccgaaaacgatccacggcggattctgggtgaaagcagtgaagaagaggagaattaaggaatgacaaagccaaaaaagaaacggtttgaagtaacggaacatgaaacgattgacaccattctcactttaatgaaggaagaggggtatatgcccgtcaggcggatggaagagcccatctttacagaaaagaaagaaaatggatcaattcaagtcgttccttgcgggaaaaaaatcgtatttgaagggaaattgatctaaacacgaacattaaaagaaagaatttttatatcgttcgataatgtcgttgacattatccaagtccgttgttaagataaacatgaaatcaaaacacgacctcatataatcttgggaatatggcccataagtttctacccggctgccgtaaacggccggactatgcaggaaagtgataaacagctgacatggatatcgcagaagcgaacgactgacgatacgcgcgccatgcccggtttgtattgcttcctcatagttgcaatataagccgggcttttttttctgaaaaacaaagcatgagaaggtgggaacagaatgcagccgctagcaggaatcatcatgggaagcacctccgattgggagacaatgaaacatgcatgcgacatacttgacgaacttcacattccttatgaaaaacaggtagtatccgcgcatcggacgcctgatttgatgtttgaatatgcagaaagcgccagagacagaggcttaaaagtcattattgccggagccggtggagcggcgcatctgccgggtatgacggcggccaaaacgacactgccggtgatcggcgtaccggttcagacaaaatcgcttaacgggcttgattctcttctgtctatcgtacagatgcccggcggcgtgccggtcgcgacaacggcgatcggaaaagcgggcgcagtgaacgcgggtctgttagccgcgcagattttgtcggcatttgacggtgacattgcggataaactagaggcgagaagaaatgcgacaaaacaaacggtgctggaaagcagtgatcagcttgtctgataaaaaaacgatttatcccggcgccgtcatcggcattatcggaggcggacagctcggaaaaatgatggctgtcgccgcaaaacagatgggctataaagtcgcagtcgtcgatcccgtgaaagactcgccatgcggacagatcgccgatattgagattaccgcccagtataatgaccgtgaagcgattcaaaaattggccggagtcagtgacatcattacgtacgaatttgaaaatatcgattacgaggcgctcaactggctcaaagaacatgcatatcttccccagggaagcgagctgctgcttatcacccaaaacagggaaacggaaaaaaaggcgatccagtcagcaggctgtcaagtcgctccttatcggatcgtaaacagcggacgggagcttgaggaagctgttcagtccctggggctcccggcggtgctgaaaacatgccgcggcggatatgacggcaaaggccaatttgtcattaaggaagaaggacagacagacgaagcggccgcgctgctagaaaacggcacgtgcatactggaaagctgggtatcattccggatggagctttccgttatcgtgacgagatcggtgcacggtgagatttcaacctttccggctgctgaaaatatccacaaaaataatattctgttccaaagcatcgtgcccgcgagagcggaggaaacggttcaaaagcgggcagaggcgcttgccgttcagctcgcggagaaattggagcttgtcgggccgcttgcggtggaaatgttcgtcacagaagacggagaccttttgatcaatgaactggcgccgcgtcctcacaactccgggcattatacgctcgacctttgtgaaacgagccaattcgaacagcacatcagagcggtatgcggacttcctctcggcagaaccgatcttctcaaaccgggaatgatggtgaatctgctcggtgaggaagtgaagcttgcggaggagcatacggagcttttaaaagaagccaaactgtacctgtacggaaaacatgagattaaaaaagggcgcaaaatggggcatatgacatttttgcggaagcctgatgaaacatggattcaggacatcacgaacatatggatgaaaagagacggaggacgagcataatgatcgaacgttattcaagacctgaaatgtccgcgatctggacggacgaaaacagataccaggcatggctggaagtcgagattttagcctgtgaagcctgggctgagcttggcgtcattccgaaagaagacgtcaaggtcatgcgcgaaaacgcgtcttttgacatcaaccggattttggaaatcgagcaggatacgcgccatgacgtcgttgcatttacccgcgcggtttcagaatcattaggcgaagaaagaaaatgggttcactacggcctgacgtcaacagatgtcgtggataccgctctttcctatctattaaaacaggcgaatgagatcttgctcaaggacattgagagatttgttgacattataaaagaaaaagcgaaagaacataaatacacggtcatgatgggccgcacgcacggcgtacacgcggaaccgacgactttcggcctgaagctcgcgctttggcacgaagaaatgaaacgcaaccttgaacgtttcaagcaggcaaaagaagggatcgaagtcgggaagctttccggcgcggtcggcacatatgcaaatattgatccgttcgtagagcagtatgtctgtgaaaaactcgggctgaaagcggcgccgatttccactcagacattacagcgcgaccgtcatgcggattacatggcggcactggctttgatcgcgacgagcattgaaaaattcgcagtggaaatccgcggtctccaaaagagtgaaacacgtgaagtggaagagttttttgctaaaggacaaaaaggctcatcggctatgcctcataaacggaatccgatcgggtcggaaaatatgacaggcatggcgcgcgtgatccgcgggtacatgctgacggcatacgaaaatgtaccgttatggcatgagcgtgatatttctcattcatcagctgagcgcatcattcttcctgacgcgacaatcgcgctgaattacatgctgaaccgattcagcaatatcgtcaaaaacttaacggtattcccggaaaatatgaaacgcaacatggaccgcacactcggtttgatctattctcagcgcgtgctgcttgctttaatcgacacgggtctgcctcgtgaagaagcatatgacacggttcagccgaaagcgatggaagcgtgggaaaaacaagtgccgttccgccagcttgtcgaagcggaggaaaaaatcacgtcccgcctcacaccggaacagattgccgattgctttgactacaattatcatctgaaaaacgtcgacttgatctttgagcgtttaggtttatagaagaagccagccggaggcggcttcttcagccgccgtagattgaatattcccaacattcgggttaggaggccttccgtgaatattgtgaacaataatcttctttatgaaggaaaagcgaagcgaatttatcaaactgaagacgaacagattctccgcgtggtctacaaggattccgcaacagcctttaacggtgagaaaaaagcggagatcagcggaaagggccgtctgaacaatgaaatttcaagcctgattttcaaacatctgcacgccaaaggaattgacaaccactttgtggagcgtgtttcagaatcagagcagctcatcaaaaaagtgagcatcattccgcttgaagtcgtggtcagaaacattgccgccggaagcatgtcgaaacgtctcggcatcccggaaggaacagagctcccgcagccgattatcgaattttactacaaggatgacgcactcggcgatccgctcatcacagaagatcatatccggctcttaaaagcggcggctcctgagcatgtcgaaacgatcaaatcgattacaaaccaggtgaatcaagaacttcagcatatttttgaagactgcggggtcagattaatagattttaagctggaattcggcttagacgcagagggacgggtgcttttagcggatgaaatttctcctgacacgtgccgtctgtgggacaaagacacaaacgaaaagctcgataaagatttgttcagacggaacctgggaagcttaaccgacgcatatgaagagattttcaaaagactgggaggcatttcataatgtataaagtgaaagtttatgtcagcttaaaagaaagtgtgctcgatcctcaaggaagcgcggtgcagcatgcattgcacagcatgacctacaatgaagtgcaggatgtgcgcatcggaaaatacatggagctgacgatcgaaaaatctgaccgcgatcttgacgcgctcgtgaaagaaatgtgtgaaaagctccttgccaatacagtcattgaagactaccgatatgaagttgaggaggttgtcgcacagtgaaatttgcggtgattgtgttacccggctccaactgtgatatagatatgtttcacgccgtaaaggacgaactcggcgaagaagtcgagtatgtctggcacgaggaaacaagccttgacggatttgacggcgtgctcatccccggcgggttttcatacggcgactacttgagatgcggcgccatcgccagattcgcaaacatcatgccggccgtgaaaaaagcggctgccgaaggaaaaccggttctcggcgtctgcaacggattccagattctgcaggagctcggacttctgcccggcgccatgagacgcaacaaagatttaaagttcatctgccgccctgttgaattaatcgtacagaacggcgatacgttattcacatcttcctatgaaaaaggacaatcgattacgattccggttgcccacggcgaaggcaatttctactgtgatgacgaaacgcttgaaagattaaaagaaaacaatcaaatcgtcttcacatacggcggcgatattaacggaagcgtcagcggcattgccggcgtcgtgaatgagaaaggcaacgtattaggcatgatgcctcaccctgagcgcgcagtcgatgaactgctcggcagcgcagacggtcttacattgttccggtctatcgtgaaaaattggagggaaactcatgtcgctactgcttgaaccaagtaaagaacaaataaaagaagagaaactctatcagcaaatgggtgtcagtgatgacgagttcgcactcattgaatctattatcggaagattgccgaactacacggaaatcgggattttttccgtgatgtggtcagagcactgcagctataaaaactcaaaaccggttttacgcaaattcccgactagcggcgaacgcgtgctgcagggtcccggagaaggcgcgggaatcgttgacatcggtgacaatcaggcggtcgtgttcaaaattgaatctcataaccacccgtcagcgcttgagccataccaaggtgctgcgacgggagtgggcggcattatccgtgacgttttctcaatgggcgcccgtccgatagctgtattaaactctcttcgatttggtgaactcacttcacctcgtgtgaagtacttgtttgaagaagtagtggcgggaatcgcgggatacggaaactgtatcggtattccgacggtcggcggagaagtgcagtttgacgcaagctatgagggcaatccgcttgtcaatgcaatgtgcgtcggcttgattgatcataaagatattaaaaaaggccaggcgaaaggtgtcggcaacacggtcatgtacgtcggcgctaaaacgggccgcgacggcatacacggcgctactttcgcatcagaagaaatgtcagattcatctgaagaaaaacgttccgcggtgcaggtcggcgatcctttcatggaaaaacttctcctggaagcatgccttgaagtcatccaatgcgacgccttagtcggcattcaggatatgggggcggccggtctgacaagttcgagtgctgaaatggcaagcaaagccggctccggcattgaaatgaaccttgatctcattccgcagcgggaaacgggtatgaccgcttacgaaatgatgctttccgagtctcaggaacgcatgcttctcgtcattgaacgcggacgtgaacaggaaattgtcgatatttttgataaatatgaccttgaagcggtttccgtaggtcatgttacggatgataaaatgctccgcctccgccataacggagaggttgtttgcgaacttccggtcgacgcactggcggaagaagcgcctgtataccacaaaccgtcagcagaacccgcgtactaccgcgagtttcaggaaacagaagttcccgcgcctgaagtaaaagatgggacagagacgctttttgccctgctgcagcagccgacaattgccagcaaagagtgggtgtatgatcaatatgactacatggtgcgcacaaatacggtggtcgctccgggctctgacgcgggagtgctcagaatccgcggcacgaaaaaagcgctggcgatgacgacggattgcaacgcccgttatttatatcttgatccagaagaaggcggaaaaatcgccgttgccgaagcggcgcgcaacatcgtatgctccggcgccgaaccgcttgcggtcacggataatctgaatttcggaaacccggaaaaacctgaaattttctggcagatcgaaaaagcggccgacggcatcagcgaggcgtgcaatgttctcagcacacccgtcatcggcggtaacgtatcactttataatgaatcgaacggaacggccatctacccgacgcctgttatcggcatggtcggcttaattgaagataccgctcatattacgacacagcatttcaaacaagcgggagatcttgtatacgtgatcggcgaaacaaaacctgagtttgccggaagcgaactgcaaaaaatgacagaaggccgcatttacggcaaagcgccgcaaatcgatcttgatatagagctgtcacgccaaaaagcattgcttgacgcgattaaaaaaggcttcgttcaatccgcgcatgacgtatctgaaggcggcttaggcgtagcgattgcagaaagtgtcatgacgacggaaaaccttggcgccaaagtgactgttgaaggggaatcggcattattattctctgaatctcaatcccgcttcgtcgtttcggtcaaaaaagaacaccaagcggcgtttgaagcagctgcggctgatgcggttcatatcggtgaggtaacggctgacggacttctggcgattcaaaaccaggacggacaacaattggttcacgcgcaaacgaaagaacttgagcgcgcgtggaaaggagctattccatgcttgctgaaatcaaaggcctgaatgaagaatgcggtgtgtttggcatctggggacatgaagaagccccgcaaattacgtattacggtctccacagcctccagcacagaggacaggaaggcgcgggaattgtcgcgactgacggtgaaaaactgacggcgcacaaaggccaagggctgatcactgaagtatttcaaaacggcgagctcagcaaagtaaagggaaaaggcgcgatcgggcatgttcgttacgcaacggctggaggaggcggatatgaaaatgttcagccgctcctgttccgttcgcaaaacaacggcagcctcgcgctcgcccataacggaaacttggtcaacgccacacagctgaagcagcagcttgaaaaccaagggagcatttttcagacttcctccgatacggaagtgctggctcatctgattaaacgcagcggacacttttcactgaaggatcaaatcaaaaattcgctatctatgctgaaaggcgcttatgcctttttaatcatgactgaaacagagatgatcgtcgcgcttgacccgaacggactcagaccgctgtcaatcggcatcatgggcgatgcttatgtggtcgcttcagaaacgtgcgcatttgatgttgtcggcgcaacgtaccttcgtgaggtagagccgggcgaaatgctgatcatcaacgatgaaggcttgaaatcagagcgtttttccatgaatatcaaccgttccatctgcagcatggagtacatttatttctcaagacctgacagcaatatcgacggcattaacgtgcacagcgcccggaaaaacctcgggaaaatgcttgcccgggagtccgcggttgaagcggatgtcgtcacaggcgtgcctgattccagtatttctgcggccatcggctatgctgaggcgacgggcatcccgtacgaactcggtctcattaaaaaccgttatgtcggcagaacgtttatccagccgtcacaggctctccgtgagcaaggcgtcagaatgaagctgtccgccgtccgcggtgttgtcgaaggaaaacgggtcgtcatggttgatgattccatcgtgcgcgggacgacaagccgccggattgtcacaatgctcagagaagcgggggcgacagaggtgcacgtcaagatcagttcaccgccgatcgctcatccgtgcttctacggtatcgacacatcaacccatgaggagctgatcgcttcttctcattccgtggaagaaatccgccagatcatcggtgccgacacgctttctttcttaagtgtagacggattgttaaaaggagtcggccgaaaatttgaagacaccaattgcggacaatgcctcgcttgttttacgggcaaatatccgacggaaatttatcaggatacagtgcttcctcacgtaaaagaagcggtgctgacaaaataaaatgtgaaaatgacataaaggcagcgggaattcaggctgcctttctctttctgcctttttaggagaaacgaattgacaaggagtgatagggatgtctgatgcttataaaaatgccggagttgacatcgaagccggatacgaagccgtcaaacgaatgaaaaaacacgtggagcgcacgaaaaggctcggcgttatgggaagcctgggcggttttggcggaatgtttgatctgtcagagcttccgtatcaaaagcctgttttaatttccggaacagacggtgtcggcaccaaactgaaactcgcattttcaatggataagcatgacacgatcggcgtcgatgcggtcgcgatgtgtgtaaacgatgtgcttgcccagggagcggagccgctgtttttccttgattatttggcggtcggcaaggccgatccggtgaaaattgagcagatcgttcagggtgtggcggacggatgcgagcagtcaggatcagcgcttatcggcggtgagacggcggaaatgccggggctgtatacgtctgatgaatacgatattgcgggcttttcagtcggcgtcgcggaaaaagacgaaatcgtcaccggtgaacatatcgaagaggggcatctcttaatcggacttacttcaagcggccttcacagcaacggattttccctggtgagaaaagtgcttcttgatgacggcggacttgatttggatactgtctatgaaccgtttgcgcgtcctctcggagaagaattgctggaaccgacgagaatatatgtgaagccggtgctcaaggcggtgaaaagcggtaaggtggacggcatggcgcatgtgacaggcggaggattcatcgagaatatcccgcggatgctgccggacggattgagcgcggaaattgatcacggatcatggccgatcccgccgatttttccgtttctgcaggagcacggcaagctgaaagaagaagaaatgttcaatgtctttaatatgggcatcggttttgtccttgccgttaaagaagaaaacctgacagacgtcatcggcacgcttgaagctcagggcgagaaggcttatctgatcggccgggtcaagcggggcgaaggcatttctttcggcggtgcggctctttcatgaaaaagtttgcggtatttgcttcaggaaacggatcgaacttcgaggccattgccaaacgcatgagagaagagaagtgggatgcggagctctcgcttctcgtgacggataagcctcaggcaaaggcggcggaaagggcggaggctttacatatcccgtcattcgcctttgaaccgtcatcttttgaaaacaaagcggcctttgaacgggccattattgaacagctgcgcctgcacggggcggaattaatcgttctcgccggctatatgagactgattggagatacgctgcttgaagcatacgggggccgcattattaatatacatccctcgcttcttccggcattccctgggattgacgctgtcggacaggcgtatcgggccggtgtgaaagtggcgggcattaccgttcattacgtcgacgaaggcatggacaccggaccgattatcgcgcaaaaagcattcgaaatacaggaaaacgatacgcttgaagacatagagcatacaatacacgagcttgagcacaaatggtatccgagcgttgtgaaacggctgctgggactaaataacagaggtgaaaaggcatgacaatcaaacgcgcactaatcagtgtttctgataaaacaaatctcgtacctttcgtaaaggaactgacagagctcggcgtcgaagtcatttcgaccggaggaacaaaaaaacttcttcaggaaaacggtgtggatgtcatcggcatttcagaagtgaccggatttcctgaaattatggacggacggttaaaaacactccatcctaatattcacggcggtctgcttgccgtaagagacaataaagagcatatggcgcagatcaatgaacacggcattgcaccgattgaccttgtggtcgtcaacctttatccgtttaaagaaacgatttcaaaagaagacgtaacatacgatgaagcgatagaaaacattgatatcggcggtcccggcatgctgcgcgccgcatcgaaaaaccatcaggatgtgacggtcatcacagatccggccgattacagctccgtgctcaatgagatgaaagaacacggcggcgtttcgctcaaaagaaaacgcgagcttgcggccaaagtattccgccataccgcggcatacgacgcattaatcgctgattacttaacacgcgaggccggtgagaaagaccctgagcaattcactgttacttttgagaaaaaacagtcgctccgctacggtgaaaaccctcaccaagaggcggttttctaccaaagcgcacttcctgtctccggttccatcgcagcggcaaaacagcttcacggcaaagagctttcttataacaatattaaggacgcggatgcggccgttcaaatcgtccgggaatttacagaacccgcagctgttgccgttaaacatatgaatccatgcggagtcggtacgggagcttcaattgaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgtacagggcggtcttttgattcaagatttagacgtccatggatttgatgacgccgacatcaccatcccgacaaaaagagagccgagcgagcaggaatgggaagatttgaagctggcctggaaagtcgtcaaacatgtgaaatccaacgcgatcgtccttgcaaaagaccatatgacggtcggtgtgggcgcaggacagatgaatcgcgtcggttcagccaaaatcgccattgagcaggccggagaaaaagcaaaaggcagcgcgctcggatcagacgcgtttttcccgatgccggatacagtcgaagaagccgcaaaagccggtgtcacggcgattatccagcccggcggatcggtccgcgatgaagattcgattaagaaagcggatgaatacggaatcgccatggtattcaccggcatcagacatttcaaacattaaggggggaacgaagcgtgaatgtattgattatcggaaaaggcggcagagagcatacattggcttggaaagcggcgcaaagcccgcttgttgacacggtgtacgccgcgcccggaaatgacggtatgacagactgcgcgacgctggtcaacattggagaaagcgatcatgccgcactcattgcgtttgcgaaagaacatcatgtcggcctgacgattatcggccccgaagttcctctgattgaagggatagccgacgagtttgaaaaagccggactgcttgttttcggaccgtctgaaaaagcggctattattgaaggaagcaaacagtttgccaaggatttaatgaaaaaatacggcattccgacggcggagtatgagacgtttacttcatttgaagaggcgaaagcatatgtactgcaaaaaggcgcgccgattgtcattaaagcggacgggcttgccgccggaaaaggtgtcacggtcgcgatgacggaagaagaagcgattgaatgtctgcacgattttcttgaggatgagaaattcggggaggcgagcgcatctgttgtcattgaagagtttctcgccggcgaagaattttctttaatggcgtttgtaaaaggggagaccgtctatccgatggtcatcgctcaagatcataaacgcgccttcgatggagacaaagggccgaatacgggcggaatgggagcctactcaccggtgccgcacatttccgatgatatcgtcagaagcgcagtcgaaacgattgtgaagccggcggcaaaagcaatggtgaaagaggggcgctccttcacgggcgtgctgtacgcggggctgattctgacggaaaacggatcaaaggtcattgaattcaacgcgcgcttcggagatccggaaacacaggtcgtcgtgccgagaatggaatctgacctcattcaggtgctcttagatcttctgcatgagaaagatgttgacctaagatggaaggatacggccgcggtcagcgttgtcctggcttctgaaggctatccggaaggctatgcgaaagggacgccgatcggcagtttgacgtccgctgaagacgggatcgccgtttttcatgccggaacgaaaaaagacggcggacaatttgttacgaacggcggccgggtcgccaatgtcacggcatttgctgagacatttgaagcggcgagggataaagtgtacagcgccgtttcagggctgacaaaacccggactgttttacagaagcgatatcggcgcccgtgcgctgaaagcatcgcagcgataaagaggaaacccccgcgtcttaaaagatgcgggttttcttctgaatgacgactaagattgtcatgcagtcttgaattctgtcccggcttttgtgatgccgggatcgccggcagattcttctcatactcgcgggacaggagaaaaaaataacaagccgaaacggcttgttatttttcttgctgatggatgtcatcctgattcattccggcttggaacatatatgtcaccggacagaagcggaggatgccggacgccgctttcatcgcgcccatcatcatacagaagagatgcatcttgcaccaaggttttctcgtgtatttcgctgaagcggcagacaaaatggtgaggccgcaagtgatgcgcataacggcgtttaataaactgatattcggtttcatcatttcagctcccttagaaaaagtttttcattcatcttcaataatttgtaacgttttagccgtgcgataattgtgcggatgtgatacgatgggtctaatataagcgaaggagagtatgtgaatgtccgagcgtacctttaactggaaaaataaagacatcagatcacaggcggatgttgtagactcaaagctgcttccaacgctacttttacgggatgctctcgtattaaatccttttttaaaacaatggctgaaaaagaacgtctggatttacggagaccgaattgtatatgttggtcatgagcttcctgatgcagcagagcacattcataccataaattgtgaaggaaaatacattgtgccaggttacattgaaccgcatacacatccttttcaaatatataatccccaaacgctcgccgaatatgtgtctcaattcggaacaacgacgtttgttaatgataacttgttttttcttttgcacagcggtaaaaagaaagcgcttactatattggaagaactaaaaaaacagccggtgcaatatttctggtggtccagatatgatctgcagactgaagtgctgaatgaggaccagctcctttcttttgatgtccgcaagcaatggattgagcatccggatgtcattcaaggcggagaattgaccggatggccgcgcctcatggacggcgatgacttgatgcttcattgcatgcaggcgacaaagaaactgcgcaagcggatagaagggcattttcccggagcttctgaaaaaacactgacgaagatgaaactgttcggggctgattctgaccacgaggcgatgaatggcgacgaggtgatgagacggcttgaattgggttactatgtttcgctcagacattcatccatccgccctgatttgagaacgattttgcaggatctccatcaaaaaggcttccggcattatgatcatttcttttacacgacggatggagcgacgccgcatttttataaaggcggcatgacgaatgaattaatcaaaatcgctttggaggaaggggttccggcgattgacgcctacaatatggcctcctttaatatcgcgaaatattatcagatggatgactttctcggtgtgatcggtccgggccggcttgcttcattgaacattctcgatgacccgatgaatccggacccggtcacggtgatctccaaaggcatcctgctgagggaagacggccgaaatatgaatgcgtttacagaaacggattggaaaaagggcggtcttgtccctcttgagctttcatatgatatgacgatggatgatttacagttttcaatgccgatgggtgtgataatgcgcaacgccgtcattatggagccgtatatgattgcgattgataattctgttgaccagctttcttttgatcatgatgaatgctatctcacgcttctcgataagcatggaaaatggcgggtcaatacaatgctgaaaggttttgccgatcgggtgcagggctttgtcagttcctacacgacaaccggagatattatcgctgccggaaaaaataaagaagatatcctgctcgctttctcacggatgaaagaaatcggcggcggaatcgtgcttgccgaaaacgggaagattcttcatgagattcccctcgctttaaacggttctgcatccgcggagaattatgaagaagtgcttgagaaagagcaaaaactgaggacgctgctggaggagcggggctaccgattctgcgatccgatctatacgctgctttttttgcagagcacacacctgccttatatccgcattacgccgagaggaatattcgacgtgatgaaaaaaactgtactctttccatcgataatgcgttaaaatataaaagcagggagccgacatatgaaaagatggaaaaccgtttgtatgctttgttttgcgtttttgctgcttgccgcctgccggcagaacaatgccgatcaggtgcagccgaaagaagcggaagctcctttaacggggctgaaaactgagcagaagcttgcagaacgccgtccgattgcagtcgcagtgaacaatcatccgaaggcgaggccccaatccgggctgtcaaaggcggatgttgtcatcgaagcgctcgcggagggccggattacgcggtttctcgcgatttttcaaagtgagatgccggaaacggtcgggcctgtgcggagcgcgagggaatattttgtcacgctcagcagcgggtttaacagcatatttgtccatcatggctggagtcccggcgctaaaaagcagctggagtccggaacttacgattatataaacggtttgaatttcgacggcagcctgttttggagagccgatttcagcaagccgccccacaattcctacacgtcttatgacaatatcaggaaggcggcggaacaaaaaggatacaagctgaacggaaaaacagaaccgctcccatttcagacatcagatgcaaaacccggaaacgaaacctacaatattcggatagattatggaacacaaaatgttacaaatcttgtcgaatacgattatgataaaaaagctgatgcttatacaagaagctctgatggtgtgaaagcgacagaccgggagaccggaaagcctttagccatgcacaacatttttattgttgaagccggccatcgcatgacagacaaagatggaaggcgggccatcgatattcagtcaggggggaagggcctcctgcttcagcacggcgatgttatggagtcagactgggaatataaagacggccgtattctgcccgtaaaaggcggtgagattcttccgtttgtgccaggaaagacatggattaatatcgtgcctgatctcgatgcagcttccattagtaaaggagaaggtgtttgacgatgcaaatcgataaattacgcggaaaagaactggaccagttatttttatctattttatcgctgaaagatctggaggaatgctatcgtttctttgacgatctttgtacgattaatgaaatccaatcgctggcgcagcgtttggaagtggcgagaatgctccgcgaaggaaatacgtatcacaaaattgaaagcgaaacgggtgcttccacagcgacgatttcccgggtgaagcgctgcttaaattacggtaacgacgcctatgaaatggcgcttgaccgcgtaaacaaaggagaatcctcctcagctacgtaaaaaaccgctctgccgatgacggcaggcggtttttttatgcgtgctgattcaaaaggccgggaagttccctcaggcttccgtcttcctcccggtatacgatgtgttcagctgagaaatgaatcggcgagctgatacccgccgccgcggcaagatgaaacagcccttcacgcaacgagagcacgtagttgcagacgcgatgctgtttatcctcgatactgagcgcgcgctgaagttttggatcggttgtcgccactccgacaggacaatgattggtgtggcatacttgagcgcggatacagccgactgaaaacatcattccccgggcaatattgacaaaatccgcgcctaacgcgagggcaacggcaatcttatcgggagtgagcagctttccggatgcgaaaattttcagcctatctcttataccgtatgtcttcaaaaggccgtcaacaagggggaggccggtcagaatcggcaggccgacggaatccgccagctcatggaaagaagctcccgttcccccttcactgccgtcaatcgtaataaagtcgggaagtttgcctgatgaactcatacaggaaataaggtcttcaaggtctttgcggctgcccgggacaattttgatgccgaccggtttttcaccgacagttcttaatttctcaatgaaatcaagcatgtccggaacatttgagaactcgttgaagcggtttggactgtcaatggattgtccgggctgcacatttctgatggcggcaatttcttcggtcacctttgaaccgtcaatatgaccgcctctagctttcgccccttgcgcaagctttaattcaaaggctttaatctgctcgaggcggctttttttcttaaattcttcccatgaaaattctccatcttcagtgcgcacgccgaacagcccggggccgatttggcagataatatccgcgccgcctttcaagtgatactcagacaggccgccttcgcctgtattcatccatgtgccgccggcctggtgcagtccttttgacagggcggtgattgcccggtcgccaagtgagccgtagctcatcgctgattgtccgattaacccttttacataaaacggtttcttgcatgtgtcgcggccgatcacttgcacatcgtccggatgcaggtaataagggtccgcttttgctttttcgcggtgttcgctgcgtttcagcaggttgtctttgtcaatcttgtataccatcgtgtcgatcttcggcgtctgatctgtgcgcagctcctccctttgtttcgggaagagggcgttacggatataatagcccggctgatcgaaatcccgttctgagccgaagcccatcattctgcttttatactttcccgacatgaccgtctgttcatattctctccgggaaaacggctgttcttcgttatcattgctgaataaatactgccgcagctcaggtccgattttttcaaatatatagcgcagttttcccgctacgggataattgcgcagcactgaatgttcttcctgcttttcgtctcttatgtaaatccagagaaacaatgcggcgggaactaaaataataaaaatcaatatacaaatcagtacgataatggcttgttccattgagatcagactccttgccttttttctctttgacattccacattttgtctgttttcaaacatagccgtttcccgtccggcggagcgcaatctttttttgtgaatcaggtgaatgacgtctttttccgtttttccgggccaaacgaatttgttataatgtttaaatggcaagaaacgaatggaggaacgaaaacgcatgtacgatgttaacgagtggaagcatgtttttaaactcgatccgaataaagatttaccggatgaacagctggaacggctttgtgaatcagggactgacgccattgtgatcggaggaagcgacaatatcaccgaggacaatgtgctgagactgatgtcaaaggtgcggcggtttttagtgccgtgcgtacttgaggtgtcgacgattgattccattgtgcccgggtttgatctctatttcattccgagtgtgctcaacagcaaaaaggcggactggattgtcggcatgcatcatcaggcgatgatagaatacggagagctcatgtcaatggaggaaatcgtgacggagggctactgcatcgtcaaccctgattgtaaggcggccgctttgacggaggcggatacacatatagaaacagaagatattctcgcctatgcgcgggtcgcggaacatttgcttcatctcccgattttttatctggaatacagcgggatgctggcggacatagaaacggtggagaaaacgaaggctgtgctggacaagtccgttctgttttacggaggcggcattaaagacgcggaaacggcggaacggttcggccgtcatgccgatgtcatcgttgtcggaaatgccgtatatgaagattttgatcaggcgctcaaaacggtggcggctgtaaagacaaagtagccaagcggacgaaattgatttatgatagaacatatgtttgataggcggtgaacggatatgaattacattagcaatcaattattaagcggattaaatcccgttcagcaggaagcggtcaagacgacggacggtccgctgcttctgatggcgggcgcgggaagcggaaaaacacgtgtgctgacgcacagaatcgcatacttaatggcggaaaaacacgtggcgccatggaacattctggcgattacatttacaaataaagccgccagagaaatgaaggagcgggtggagagcattctcggacccggcgcggatgaaatctggatttccaccttccacagcatgtgcgtgcggattctgcgcagggatattgacagaatcggcatcaaccgaaacttctccattcttgatacggctgatcagctttccgttattaaagggattttgaaagagcggaatatcgatccgaaaaagtttgatccgagaagtattttaggctccatcagcagcgcaaaaaacgagctgatcgaacctgaggaattcgcaaaaacggccggcggctactacgatcaggtcacgagtgacgtgtataccgattatcagaaaaaactgctgaaaaaccaatcgctcgattttgatgatttaatcatgacgacgattaagctttttgagcgtgtgccggaagtgcttgagttttatcagcgcaaatttcagtacattcacgtagacgagtatcaggatacgaacagggcgcaatacctccttgtgaagcagcttgcggcccgtcttgaaaatatctgcgtcgtcggtgactccgaccagtccatttacagatggcgcggggcggatatcgcgaatatcctttcctttgaaaaagattacccgagcgcaaacgtgattctgctcgagcaaaactaccgctcaacaaagcggattctgcaggcggctaacgaagtgatcaaaaacaactcaaaccgcaagccgaaaaacctgtggacggaaaatgacgaaggcatcaagctttcttattacagcggcgacaatgaattcggcgaaggccaattcgtcgcgggcaaaatttatgagctgcacagctcgggccggcggaagctttccgatatcgcaattttataccggacaaacgcccagtcgcgcgtcattgaggaaacccttttaaaatccggtctgaactacaatatcgtcggcggaaccaagttctacgacaggaaagaaattaaagacattcttgcatacctgcgccttgtgtcaaacccggacgatgacatcagttttacgcggatcgtcaatgtgccgaagcgtggcgtcggcgccacttcgctagaaaaaatcgcgtcatatgcggcgatgaacggaatgtcaatgttccaggcgatcaaacaggttgatttcatcggcgtcagcgcaaaagcggcaaacgcgcttgacggctttggcgcgatgattgaaaatctgacgaacatgcaggattacctgtccattacggaactcacggaagaaattctcgagaaaacggaatacagagaaatgctgaaggccgaaaaatcaatcgaagcccaaagccgccttgaaaatatcgacgagtttctttccgtgacgaaaaacttcgaacaaaaaagcgaagacaagtctctcgtcgcgtttctgaccgatctggcgctgatcgcggatattgaccagctcgaccagaaggaagaagaagcaggcggaaaggatgccgtcactttaatgacactgcacgccgctaaggggcttgaatttccagtcgtgttcttaatgggcatggaagaaggcgtgttcccgcacagccgctccctgatggaagaagccgagatggaagaagaacgcaggctcgcatatgtaggcattacgagggcggaagaagaactgtatttaacgaatgccaaaatgcgaaccttattcggccgcaccaatatgaatccggaatcccgctttatcagggaaatacctggcgatttattggagaacctaaatgagaagaaaacacctcgcatgcagccgggaagaaaagtgcagccgaaacgcgggcccgtatcccgtcccgtttcctatgcgaacaaaacaggcggcgactcgctcagctgggcggtcggcgataaagcgggccataaaaaatggggcaccggaacggttgtcagcgtaaaaggagaaggcgaaagcaccgagcttgatatcgcattcccgagcccagtcggcgtgaagcgtctgcttgccgcttttgcgccgattgaaaagcagtaacctgaagaggaaaggaagaacatgatggacaaagaaacagcgaaacaccgggcagaagaattgcgccgcaccatcgatcagtacagttatgaatattacaccttagatgaaccgagcgtgccggattccgagtacgacagactgatgcaggagctgattgccatagaggaagagcacccggaactcagaacgcctgattcgcccacacagcgggtcgggggagcggtgcttgaatcttttcaaaaggtgcagcacggcacgccgatgctcagtctcggcaacgcatttaacgatgatgatctccgcgattttgaccgccgcgtccgtcaggctgtcggtgacggcgtcgcttacaatgtggagctgaaaatagacggtcttgctgtttctctccgttatgaagacggctatttcgtcagaggcgcgacaagaggagacggaacgacgggcgaagatatcaccgaaaacttaaaaacgatccgcaacattccgctgaaaatgaaacgtaatctttccatagaagtgcgcggagaggcgtacatgccgaaacagtcatttgaagcgctcaatgaggaaaggctgaaacatgaagaggagccgttcgccaatccccggaacgcggctgcgggctcactcagacagctcgatccgaaaattgcagcgaaacgaaatcttgacatcttcgtctacagtatagcggagcttgacgagatgggtgtggaaacacagagtcagggcctggattttctggatgagctcggttttaaaacaaaccaggaacggaaaaaatgcgacacgatagatgaagtcattgaaatgatcgaagagctgcaggcgaagcgggccgatctcccttatgaaattgacggaatcgtcatcaaagtcgattcgctcgaccagcaggaagaactcgggtatacggcaaaaagcccgcgctgggcgattgcttacaaattcccggctgaagaggtcgtgacaaaactgctcgatatcgaactgaatgttggaagaacgggcgttattacgccgaccgccgttctggaaccggtaaaagtcgcgggaacgacggtctcaagagcatcccttcataacgaagatttaattaaagagaaggatatccgcattctcgataaagtggtcgtcaaaaaagcgggcgacatcatccctgaggtcgtcaatgtcttaattgaacagcggaccggggaagaaaaagaattcaatatgccgaccagctgccctgagtgcgaaagcgaacttgtccgcattgaaggggaagtcgcgctgcgctgcatcaatccggaatgtccggcgcagatcagagaaggcctgattcactttgtctcacgcaacgcgatgaatattgacggactcggagaacgtgtcatcacacagcttttccgtgaacatctcgtccgtaatgtcgctgatttgtataagctgacgaaagaacaggtcatccggcttgagcggatgggggaaaaatcaactgacaatctgatcagctccatccaaaagtcgaaagagaattcgctggaacgcctgctgttcggtctcggtatccgttttatcggctcaaaagcggccaaaacactggccatgcattttgaaagcctggaaaatctgaaacaagccacggaagaagagctgcttgcggtagatgaaatcggcgaaaagatggccgatgccgttatcacctatttccgcaaagaggaaatgcttgagcttttgaatgaacttgaggaactcggtgtgaacacactctacaaaggcccgaaaaaagtaaaagcggaggacagcgactcttattttgccggtaaaaccatcgtgttaaccggaaagcttgaagagctgtccagaaatgaagccaaggcgcagattgaagcgctcggcggaaagctgacgggatctgtcagcaaaaaaacagacttgctgattgccggagaagcggccggaagcaagctgacaaaagcgcaggagttaaacattgaagtatggaatgaagcacagctattgggagagctaaagaaataagaggagtgttttctattgaaaaagatgttggcattggcggcgacggcaacggcggcagtactcatgctgtcggcctgttcgccgagtttcgggggaaaaaaagaggaagagatcacgcagaaaacggcaaagtcttctgaaaaagcgatcataccgaaatataatatctctgattcctactataaaatggtgctcccgtttaaggccggaaaagcgcgcggcctgactgcggaccggctgaacacgaggctggacatcgatgaattcgagacggggctgatgcggctcgctcaagacacgttcccgacggatgactatttgtatcaggaaggccagtatttagatgaggacacggtactcagctggcttgaccgcaaaaaagagggcagtgatctgaaaaaggcgaaaaaggcagacgccaatttccagaatctcggcttaaacccggtgctgccaagctcgggatcagcaaaagagaaaaacgaaaacagcccgatttacttagcgtccatgcttgagcaggattacttagtaagaaaagataaaaattccatccagcttggcggtgtcatgatcggtctcgctctcaactctgtatactattaccgcgaaaacacaggtgatccgcagcaggaagtggagctcagcgacaaaacgatccgcagccacggtgaagaaatcgcacaggaagtcgttaaccgccttcggaaaatggataacctgaaaaatgtgccgattaccgtcgccctttataaacaagcgccgaaaacatcaatcgtaccggggaattacattgcgaaaacagaagtcaaggccggctcatccaccatttcaaactgggatgatgtcaaagaaaagtacgtcttctatccggcggatacagacacggcaaagaaataccctgatgattccgaagtgtttaaacgcttcaaaaacgccatcgacagctacttcccgaattacaccggagttgtcggaacggcaatgtacgaaaacgatgaaatgagaaaaatgaagattgaaatcccgatgcaattttacgggaaaagcgaagtcatcgccttcacccaatacttaacaggtgagctgatggattattattcaaaaggctcagttgatgtcgaaattaacattacctcgtctgacgggcaggaagcgctgatcgtccgcaatgcgggtgacaaagaaccgaccgtccatatttacgattaaccaagatgcccttgttcatttctgtatgagcaagggttttttagtgtgaatatcgttggagagaggaatgaggtatgttaagatatttgtataattaggaattaacaggaaaacacatttcatttctaagcggatgttacgaatctgctgtgaaaaaagaagggcaggaatgttgatgaatgacatttgctgagtacacacaccgcctacaaatgttatgaaaagggtgaatcagcatgcataaagatattaaagcgatttttgaggaagataaggtgctggctgaagccggtgaaatatacggatttaccaagtttcaatttattgcggacgcagagaactacgtatatgaaattgtgaaagataacgaaccgtatatcttaaaaattacgcatacgatcagaagaacgccggaatatattctcggagaaatggaatggcttcatcatctggcaaagggagggctttcagtagcaaagccgattccttcattaaatggcaaagatgtcgaagaagtgccggacggaaaaggcggagcgtttttattaagagtctatgaaaaagcgcccggacgcaaagtggaggaatcagactggaacggaactctgttttaccagcttggaaagtacacggggaacatgcaccggctgacgaaaagctaccgtctgagcgatccggcatataaaaggcaggaatgggatgaagaggagcagctgaagctgagaaaatacgtgcccgcagatcagcatctcgtatttgagcgggcggatgctctaatggaaaaactgcgccgtttgccgaagaatcctgaaaactacggccttgtgcacgccgatctgcatcatggcaattttaattgggacaacggaaaaatcactgcatttgattttgatgatatcggctacaattggtttgtgaatgatatcagtattctgctgtacaacatgttgtggtatccggtcatcccgtatgaagacaaggccgcgtttacgggtgaattcatgactcactttatgaaaggctacagggaagaaaatgaccttgattccgcatggcttgaacacatcccggatttcctccggctgcgccatatgctgatctacggattattgcatcaggcgtttgacctcaattcactcggggacgaggaactcgggatgctgaaagccttcaggcgcgatatcgaaaatgaaacaccgattacggagtatcaattttctgcattcgtataaatagaaaaacgccggctgaatccagcccggcgttttttataacgtatcacattttactccgacgacgccctgaatttctttaatatcataatagacgtcagtggtgtagcggtttttatgaacactgactttcacttccataatcggaaattctttttcacccaggtcatcaatccggacggagtgaatgcggagctgtttgcttttcatttcctttaaaatctcggtcattttgtctttatcggaaagagacattctcacgcggatatccttttccttcaagcggttgggaccgatttttctgatcagccacggaagaaattcgacactgatcaggataaacaagaggcttgcgaacgcttctttataaaagccggcgcctgtagccagacccagcccggccgcgccccagatgatagccgatgtcgtcaggccggatatgacgtcattgcttttacgcaggatcacgcccgcgccgataaaaccgacgccggaaatgatttgggcgggaaggcggagcggatccatcatgatacggtaatatttcgggaaatgatatgccgcattaatgctgacgatcgtcagcatacaggagctgacggcgatgacgatacaggttttcagtccgagcggtttgtttttcagttcgcgttcaagaccgatgatcatgccgatcagcgtggcaatgcccagctttaataaaatgtctggttcgataggccagctcaatttgcacagcacctccgcaatttttcttataataaattgatatgattttctcacagtatttatagcaggacaagtgcggaagaaaaaagccgtcagggataaaatctgacggctttttgtctatttcttgtttttcaaaagagcttccatccggctgaacagctgataagaagcatcggccggttttttggtcagcaggctgacggcaataccggcaatcagactgaggaagaaccctggaatgatttcgtataccccggttgaagcggcaagccctgtcgtaatccagattaaaacggccgcggccccggtaatcatcgccgcaagcgctccccattcattcatccgtttccagtacagactgagcaagagcgccgggccgatagccgaaccgaagccagcccacgcatatccgaccagatcaagaatggtgctgttcggattcatggaaagcaggatggcaataacggctacgatcaataccgacaggcgtccggtcatgaccaattctttatcgctcgcttcccgtctgaaaaaggcgcggtataaatcttccgtaatggcgcttgccgttacgagaagctgtgaggaaatggaactcatgatcgccgctaaaatggcggacagcaagaagcccgtaatcaacggatggaacaagattttagaaaaaataatgaaaatcgtttccggatcttttacggagaccccgaagtgatgagaatacgcaaccccgataatcccggtcagcaatgagccgacaactgaaataaacatccagctcatcccgattctgcgggcgggttttaaatctttcacttctttaatcgccataaatcgtacgatgatatgaggctggccgtaatagccgagtccccatgccaaataagaaataatgctaatgacgctcgcgcctttaaagatatccaatagtttcgggttaacggcgttgatcgaatcaatcgtcgttgaaacgctcccgagctgggtaaaagcaacgatcggcacaagcactaatgccgcaaacatgatcgctccctgtacaaagtcagtcagactgacagcgaggaaaccgccaaacagcgtataaagcacaactacacccgccgttaaaaacaaaccgaatttgtagtcggcgccgaatgccgattcaaataacctgcctccggataccatcccggacgatgtgtacagtgtgaaaaagatcataataatcacggcggaaacaattttcagcaatgatgacgagtggcggaaccgtttatcgaaaaaatcgggaatcgtaatcgcatcatccgcaacttccgtgtaagcgcgcagcctcggagcaagcagcagataatttgaatacgcgccgatcgtcaaaccgagcgccagccataaggtcgataaccccgttgcgaacattgcgccgggaactcccatcagcatccatgcgctcatatccgccgcacctgcggacagcgccgttacgaacggaccgagtcctcttccgcccagcatgtaatcattaatattcgttgtctttctgaatgcgtaccagccgattaacagcatggcggcaaagtaaatgccaagagatataattaattcaatactcacgtttttggaccctctcttctttcatgtaaatgttgcatcacctctgtagattagtagtgccggaatatgtgccggcgatccagcctgcctttagtcatctttcgatggggatcgcatgatttagtgccggctatggttactaaacctaacaaagtatccccgatcaatcaactctcgaaacctggcccgctcaagaaaaaaatccccgccaacctagaacagcttaaagatgaaaacgctaccaataaattataaaagtaaaaattttctgacatataattcgtttctctttctccccgatttaggataaaatagagagggtttcatcatgcctcagaaggcggcgttttgttgctttagagggctcgtttttgatatgatcagtattatatgacgaaacggagaattatgcggaggtggatcttatgtcacgaatttctatagaagaagtaaagcatgtcgctcatttggcgagactcgccattacggatgaagaagctgaaatgttcacagaacagcttgacagcatcatctcgtttgccgaggagcttaatgaagtggacacggataacgtggaaccgacaacacacgtgctgaaaatgaaaaacgtaatgagagaagatgaagcgggtaaaggccttccggtcgaggatgtcatgaaaaatgctcccgatcataaagacggctatgtccgtgtgccatctattctggattaaaggagggagacagtatgtcattatttgatcacaaaatcacagaactgaaacaaatgatacataaaaaagaaatcaagatttccgatcttgttgatgaatcttacaaacggatcgcatccgtggatgataaggtgcaggcgtttttacagcttgatgaagaaagagcccgcgcttacgcgaaagaacttgacgaagcggttgacggacggtctgaacacggtcttctcttcggaatgccgatcggcgtcaaagacaacatcgtgaccaaagggcttcgcacaacatgctcaagcaaaatcctcgaaaacttcgatccgatttacgatgcgacggttgtggaacgccttcaagccgctgaagccgtcacaatcgggaagctgaatatggacgagttcgcgatgggttcttctactgaaaactccgcgtacaaagcgacgaaaaacccttggaatctcgatacggttcccggcggatcaagcggcggttccgcagctgcggttgcagccggagaagtgccgttttcactcggatctgatacgggcggctccatccgtcagccggcttctttctgcggcgtcgtcggattaaagcctacatacggacgcgtgtcacgttacggtttggtcgcttttgcgtcttcacttgaccagatcggaccgatcacaagaaacgtagaagataacgcattcctgcttcaggcgatttcaggcccggacaaaatggactctacgagcgccaatgtcgaagtgccggactttctttcttcattaactggcgatattaaaggcttaaaaatcgccgtgccgaaagaatatctcggagaaggcgtcggcaaagaagcgaaagaatcggttttagccgctttaaaagtgcttgaagacctcggagcgacatgggaagaagtatctctgccgcacagcaaatacgcgcttgcaacgtattatctgctttcttcttccgaagcgtctgcaaaccttgcgcgctttgacggcatccgctacggctaccgctcagacaatgcggacaacctgatcgacctttataaacagacacgctcagaaggcttcggcaacgaagtaaagcgccgcatcatgctcggcaccttcgcgctcagctccggctactatgacgcgtattacaaaaaagcgcaaaaagtgcgcacgcttattaaaaaagattttgaagacgtatttgagaaatacgatgtcatcgtcggaccgacaacgccgacaccggcattcaaaatcggcgaaaaaaccagcgatccgctcacaatgtacgccaacgatattttaacgatccctgtcaacctcgcgggtgtgccgggaatcagcgtgccatgcggatttgcggacggactgccgctcggactgcaaatcatcggaaaacacttcgatgagagcactgtataccgcgtcgctcatgcttttgagcaggcaacagatcatcataaagcgaaacctgaactgtaaggggtgaaatgaagtgaactttgaaacggtaatcggacttgaagtccatgtggaattaaaaacaaaatctaaaattttctcaagctcaccgacgccattcggcgcggaagcgaatacccaaacaagcgtcatcgacctcggctatcccggcgtgctgcccgttttgaacaaagaagcggtcgaattcgcgatgaaagccgcaatggctttgaactgtgaaatcgcaacggatacgaagtttgaccgaaaaaactatttctacccggacaacccgaaggcatatcaaatatctcaatttgacaagccgatcggcgaaaacggctggattgaaatcgaagtcggcggaaaaacgaaaaaaatcggcattacccgtcttcaccttgaagaagatgcgggaaaactgacgcatacgggcgacggctattccctcgttgacttcaaccgccagggcacgccgcttgtcgagattgtatctgagccggatatccgcacacctgaggaagcttacgcatatctcgaaaagctgaaatcaattatccaatacacaggtgtttccgactgtaaaatggaagaaggttcactgcgctgtgacgccaacatttccctccgtccgatcggccaggagaaattcggcacaaaaacggagctgaaaaacctgaattccttcgcgttcgtgcaaaaaggacttgagcatgaagagaaacgccaagagcaggtgcttctgtcaggcggagtcattcagcaggagacgcgccgctacgatgaagcgacgaaaaaaaccattttgatgcgtgtcaaagaaggttcggacgactatcgttatttccctgagcctgaccttgtcgagctctacattgatgacgaatggaaagaacgcgtaagagcaaccattcctgagcttccggacgagcgccgcaagcgttatatcgaagagctcggtctgccggcttatgacgcaatggttctgacgctgacgaaagaaatggctgatttcttcgaagaaacggtcaataaaggcgcggaagccaagcaggcatcaaactggctgatgggtgaagtgtcagcttacctgaatgccgaacaaaaagagcttgaggatgtcgcactgactcctgaaggccttgccggcatgattaagctgattgaaaaaggaaccatctcgtccaaaatcgcgaagaaagtctttaaagaattaattgaaaaaggcggcgacgcagaaaaaatcgttaaagaaaaaggcctcgtgcagatttctgacgaaagcgtgcttctgaagctggtaacagatgcgcttgacagcaacccgcagtcaattgaagacttcaaaaacggaaaagaccgcgcgatcggcttccttgtcgggcagattatgaaagcctcaaaaggacaggccaacccgccgatggtcaacaagatcttacttgaagaaatcaaaaaacgataaaaaaagcagccgcctctaagggcgctgctgacacggagaccggtaagcgccggtctcttttttttataagctgaaataggtttcaatggaagcccgcagcgtttcaatctgttcatttccgctgcctgccaagttggacagcattcctttaataatcggttttcgcggctcttcctttgcgcattcctcttcaatgacttcaagcgatacgaggacgtcctcaggcagcccctgctgtgcttttatcttttgaatatccgcaagcagcctttctctgtccgccgccggctgagtgaagatatcctcaggcagcagcggatcgggattgtctcttatcagtcccataatcaggtcatcgattctggcaatcagaaaggccgccacgttttccgtccggaatgccgtatgttcattaaaaatcaagaaatgaatataggagctcactattccttgcgccataacggacgcatccgctataaacggtatgacggcatctccgtaaacggagagcaaagcatcccgatacagcatgttaaattgaatattggcctcatgaaaatactgtttgaccttttgattttcaggaatgaccttttcgctcagcaagagaatgataaaatccttgtgctccataaattcctggaattgataagcgatttgttttcggaatacgtccttaggcggtttatgctgatgttctgttttgattttctttatttcttccatagacatgccgatgtaatactcacatgctgacagcaaaaggtcttcttttgatttgaaatggagatagaaggctccttttgaaattccgcattcaccggcgatttcctgaatggttgttgaagaaaacccttttttggcaaataaatggatgcctgtttttatgattttctcttttttttcgttcatgacgtgcttccccttaatcctgaaaaatttagaaaaatttactgccttattagttgacgatgttgagttataccgtttagtattatatagaatgaccagtcagtcaataaaaattaacggaggacatgatgaaccacattattaactttgtactgaagaacaaattcgcagtttggctgatgacgattatcgttactgtagcagggctgtatgccggtatgaatatgaagcaggaatccataccggacgtcaacatgccttacctctcagtaaatacgacttatcccggagctgctccgagtcaagttgcggatgacgtgacaaaaccgatcgagcaggcggtgcagaatttagaaggagtgagcgtcgtaacgtccacatcctctgaaaacgtctcatcggttatgattgaatatgattacaacaaggatatggacaaggcgaaaaccgaagtcgctgaagcgctggacagtgtcagccttcctgatgacgcgaaaaaacctgacatttcccgttacagcctcaactcttttccgattttgacgctcagtgtgacaagcggcaaaagctcgcttgaagatctgaccaaaaatgtggaaaacactctcgttcctaagcttgaaggcattcagggcgttgcgtccgtgcaagtttccggacagcaggaagagcaggtggaattctctttcaaagacaaaaaaatgaaagagtacggacttgatgaagataccgtcaagaaagtgatccaaggctctgacgtcaatacgccgcttggattgtacacattcggcaacaaagaaaaatcagttgtcgttaacggaaatattacgtcaattaaagatctgaaagagatgagaattccggtcacatcttcttctgccgctcaaggtcaagcgggcggagccggtgcggcatctgcggcggacgctcaggctatgcagcaggcacagcaaagcgcatcagcaggggtgccgacagtcaagctttctgacattgccgacattaaagatgtgaaaaaagctgaatccatttcccgcacgaacggaaaggacagtatcggaattaatatcgtaaaagccaatgacgccaacacggtagaagtggccgatgcgattaaagatgaactgaatcaatacaaaaaagaccacaaagggttcaagtacagctcgactcttgatatggcagagccgattacagagtcagtggatacgatgttaagcaaagcgattttcggcgcgatttttgcggtcgtgatcattctcttattcttaagagatattaaatcaacgatgatttctatcgtttccatcccgctgtcactgctgattgcgcttcttgtgctgaatcagcttgatgtcacattgaacataatgacgctcggtgcgatgacggtcgccatcggacgggtagtcgacgactcgattgtcgtgatcgaaaacatttaccgccgcatgaggctgaaagatgaacctttacgcgggaagcaattggtgcgtgaagcgacgaaagaaatgtttaaaccgatcatgtcatcaacgatcgtaaccattgccgtattcctgccgcttgccatggtcggcggacagatcggcgaactgtttatgccgtttgcattaacaatcgtcttcgcgcttgccgcatcactgttgatttcgatcacactggtgccgatgcttgcgcacagcttattcagaaaatcgctcacaggcgctccggttaaagcgaaagagcataagccgggcagattggccaatttctataaaaaagtgctgaattggtcattaagacataaatggattacatctatcatcgcggttctgatgcttgtcggcagtttgttcctcgtacctctgatcggcgcgagctacctgccagcgcaagcggacaaaacgatgcagctcacatacacgcctgaaccgggcgaaacgaaaagcgaagctgaaaaagctgcgcaaaaagcggaagacatgctgcttaaacgcaaacatgtcgataccgttcagtattctttaggctcgcaaagtccgctcggcggaagttcaaacggcgcattgttctacgtgaaatacgaggatgacacgcctgattttgacaaagaaaaagacaatgtcttaaaagaaatcaaaaaaacatccagccgcggcgaatggaaatcacaaaatttcagttcgtcaggcaacaacaacgaattaacgtactatgtgtacggagattcagagtctgatattaaaggcacggtcaaagacatcgaaggcattatgaaaaagcagaaggatctgaaagacatcaactcaggcctttccagcacatatgatgagtacacgttcgtcgcggaccaggagaaactcagcaagcagggcctgacggcttcgcaaatctcccaagccctgatgtcccaaacatcacagtctcctttgacaacggtgaaaaaagacggcaaagagcttgacgtcaacatcaaaacagaaaaagatcagtataagagtgtaaaagaattagaggataaaaccatcacatcgcctgcaggtcaagaagtaaaaatcggcgatgtggcgaaagtgaaaaacggcacgacatccgataccatttccaaacgcgacggcaaagtgtatgctgacgtaacggcaaccgtcacttctgacaacgtcacgaaggtgtcatcagccgttcaaaagaaagttgacaaactggataaaccggacaatgtctccattgataccggcggtgtatcagcggatattgctgattcctttacgaaactcggcttagcgatgcttgccgcaatcgctatcgtatacctcgttcttgtgatcacgttcggcggagcattagcgccgtttgcgattctgttctcgcttccgtttacagtcatcggcgcattagccggactgtatgtatccggagagacgatcagtctgaacgccatgatcggtatgctgatgctgatcggaatcgtcgtcacaaacgcgattgtcttaattgaccgcgtcatccataaagaagcggaaggcctatcgacgagttttttttcaagcagaagacggcatacgagattgcgtccgattctgatgacggcgatcgcgacaatcggcgccctgcttccattggcattgggctttgaaggcggaagccaggtcatttctaaaggactcggtgtcaccgttatcggcggtttaatcagttcgactctgctgactcttctgattgtgccgatcgtatatgaagtattagcgaaattccgtaagaaaaaacctggaacggaagaagagtaagacagcgggccttggctccttaaacggagccggggccttttttcttctggcaattcctgtacatattgttgcgattttctcaagtcatagtataattaaaggttgttagtgttaataatggatcggatactcttaagtaggatgatgagataatgaaacgtgcacgcataatatacaatccgacttcaggacgggagctttttaagaaaaatcttgcccaggtcctgcaaaaatttgaacaagccggttatgaaacctccacccatgccaccacatgcgcgggggatgccacccacgccgcaacagaagccgctttgcgggagtttgacctgattatcgcagccggcggagacggaacgattaatgaagtcgtcaacggcctcgcgccgttagacaaacgcccgacactcggcatcattccggtcggcacaacaaatgacttcgccagagcgctgggcattccgagagagaatatactgaatgccgctgataccgtcattaacggcgtagcccgcccgatcgacatcggacaggtgaacggtcagtactttatcaacatcgccggcggaggccgtctgacggagctgacgtatgatgtgccaagcaaactgaaaacgatgctcggccagcttgcttattatttaaagggaatggaaatgctgccttcacttcgaccgacagaagtcgagattgaatatgacggcaagctgtttcaaggggaaattatgctgtttttagtgacgctgaccaactcggtcggcggattcgagaagctggcccctgattccagcctgaatgacggcatgtttgatttaattattttgaaaaaagccaatctcgcggaatttatcagagtcgcgagcatggcgctcagaggcgatcatattaacgatcagcacattatttacacaaaagcgaaccgcgtgaaagtcaatgtatcggaaaagatgcagctgaacctggacggcgaatacggcggcatgctgcccggcgaattcgtgaatctgtaccgtcatattcacgtcatcatgccgaaggagaaagcggaacagctggatgactaatacgcggacaaaatcctaaaacagtattcgttttaggattttgtcatcttttcagcgtgatcggaaacctttgaaggctgacattgaatttgaaggtttgccagcacgctgaaacaaggcttttggtaaaacgagaggtgattatagatgaaaatgaaacccccgatagaaaaaaatgaatactatgacgtgacatttgaggatttgacgcatgaaggagcaggcgtcgcaaaggttcagggcttcccgatcttcgtgccgaacgccctgcctgaggaaaaagcgcaaatcaaagtgacacgcgtcaaaaaaggcttcgctttcggccgcttgattgagctgaaggaagaaagcccgcacagaacggatgccccgtgtccgatctacaaacaatgcggcggctgccagcttcagcacatgacctatgaaggccagctcttgtttaaacagaaacaagtcaaagatgtcttagaacggatcggcaagctggacctctcaaacgtcaccgtgcacccgacgctcggcatggaagacccgtggaactacagaaacaaagcgcaggtgccggtaggagaaagagaaggcggactcgtcgccggattctatcagcaaagaagccatgacatcatcgacatgagcgcctgcctgattcagcaatccaaaaacgacgaagccgtccaagccgtcaaagacatctgcgcagcatacggtgtcaaagcctacaacgaagaacgccacaaaggctggctccgtcacatcatggtcagatatggcgtcgtcacgggcgaaatgatgatcgtcttcatcacaagaacaggcgattttccgcacaaagcgaagatcatcgaagacatcacagcgcaattcccgcacgtcaaatccatcgtgcagaacatcaatccaaacaaaacaaacgtgatctttggggacgaaacaaacgtcatctggggcgaagaatacatctacgacctcatcggagacgtcaaattcgccatctccgccagatcgttctatcaggtcaacccggaacagacaaaagtgctctacgacaaagcgcttgagtacgcggagctgcaaggagaagaaaccgtcatcgacgcctactgcggcatcggaaccatttctctcttcttagcgaagcaggcgaaaaaagtgtacggcgtcgaaatcgtgccggaagccatcggggatgcgaaacgcaacgctgagctgaatggcatcacaaacgcggaattcgcagtcggagaagcggaaaccgtcattccgaaatggtatgaagaaggcatcacggcagatacgctagtcgtcgacccgccaagaaaaggctgcgacgaagccctcctgcggacgatcatcgacatgaaaccgaagcgggtggtgtacgtgtcctgtaatccaggaacgcttgcaagagacctgagggtgcttgaggatggcggatatcagacgctcgaagtgcagcctgtggatatgttcccgcatacgaatcatgtggagtgtgtggctgtgctggaattaagagaaggcaactaacccttagggatggttgccttttttaatccgcatttttttttgcattcaggacgaactcgtgacatgagaggagtgccagaagatgtttggttaacgtctataatatagctttctatacatctctttattaatattcactttagaggggcagcttttttaatacactttcatatcttgttttttctccttactaatcattactttttctaaataactcttaagaaatacattatctatcctatccgggatgtaacccagacgtttatttaatatattctctatgatatacattttctttgtgtaatattggtaattatccgttgcgatttgaacactttctgattcatttcccttttctgattcaagtcgagatttatatagctgatcatacttctgtttgcgtatttttcttgagagccgcagtaaatgaaataattcaattgttggcagagtcattagttctggtgtagacttatccaaatctaattcagaagtatgctcacgatattctatgatttcacgtttgccatctctctgaacattatgtatgtacattaagcaaaaactacagtaatactgattatccttttgaattgaagttgcacaataagggcatgtttccattatgttctcctttcttaatgttctaagatagtatgtatttcggttgtaaacaggaattttaaatagtattgaaattcttaaccaataaaaaacccttttaatgataaaaagtttattgaatatagcatgtataaatttcctgcaaaatcaatagtgatccccttgtatagaaaatccaccgatccctaaatccaataacaaaacccgaaaataataaattatatcgttataatcaagataattatttataaaaagataataaagttggataaaaatgagaaaatcctggcgggaatgacgatataaagttagtgaacaacggtatagaatcttatttttcgaggtgaacagaatgggagaagaacaagacattattacagtaaccgatctgcgcaaaaaatatggatcatttgaagcagtgaaaggggtatccttttctgtcaaacgcggcgagctgtttgcatttctgggaacgaacggtgcagggaaatcgaccactatcgatattctctgtacgctgattaaaaagacatccggaaaagtggtaatagatggttatactcttggtgaggggaaagagaataatcatatccgcaaaaagatcggagttgttttccaagagagcattttggatgaacgattgaccgtttatgaaaatatcatgaaccgcggacaatattatcatttaagcaaggcacaagtgcaagagaactatcagtttgtaacagactatttaaaattggatgatattaaggagaaaaaatacagcgatttgtcaggaggacaaagaagaagagcggatattgcccgtgccatcatccataaaccgactatattatttttagatgagcctactacaggtcttgatccgcaaacgagagtatttgtttggaatgcgattaaaaggctgcaggaagaaacaaacatgacgatctttttaacgacccattacatggaggaggccgctgtggctgataacgttgtggtcatcaaagaaggacgtctgatcgcagagggtacaccgagtcagctgaaagatcaatatgcgtttgacagtctgcatatgatgtttaagcaaggcgttgatccgacggcatggtttgaaaataaacaactggattttacggttaaaaactctatttattcccttcgtgtagagtccactctccaagcgtttgacattttgaaaggtcttgaaggaaaaattgaatctttcgaagtgattaaagggaatatggatgatgtgtttatccatattatcgaagaacaaggaagcagtttgccagtaaaggggagcattgcataaatgaagtctttatccagtttaatcagcagaaatataaaaatatacttccgtgatcgaacgcttttgcttctctctttgctgtcagtatttatcgtcattctgttatatgccgtgttcttacagcagacacagctggacgccattaaggccctggtcggttcgacagatgattccaaagcaatggtgaacgaatggatggtggcgggattgctgtccattacagctgtgacaacgactttaggcgctttcggaattatggtgaaagataaagaaagcaagagaacgtatgactttttaacagctcctttatcaagggcgaccatccaattgagctatgtcattcattcatttgtcatcggcttgatcttttctttcatcgcctttttaggctgtgaaatttttctcgtttcaacaggcagcaagcttttaagcggtacagatatacttgaagtattggggatcattattctttcagttgcactctcgagttccataaatttatttttaacgctgtttattcacacacaaaatgcattttcgacgttaagtacgattgtcggaacagccatcggttttttatgcggagtatatgtaccgatcggcggcgtaccggtgtttgtgcagaagattattatgtatttccctatcagccacactgccgttctgttcagaaaagcgtttatgacagactcagttgataaagtgtttaaacatgcttctgcggaccaaatacaggaatatgaaaagcattacgggatcgtctacaagttaaacggccattttatcagtacggctgcgagcttgtgggtcattgtcattacagccatcatatttactgtcatatctattttcatatttaaaaaacaaaataaatgacttcttcagacgatacataacgatgtaacaggcagcatccgtttactggatgctgcctgttttgtttatcattattctttttgtgctcaattcttaattcctcaaaaagttctcggatttctcttaaaaaagtgttgaagatatctttatttacactgtatcaggctggtagatcttgcgaataaatcagttgacgtttttttggtgtcttgaagtgaaagagaaccatggtagagtcatctaatacttctgcataaagattatttttttccattcacaaggtatgatgtcacttaatttctcaccaataatctggtacagatcttgcattttcttattttccaacctttttcaccttcaatcatcgagagatcccagttataaaaaatagcccagcaataaagcgctgagccattattgatttatagaccgacgtagtttattacaaattctttatcgttctcatcttcaggcaaaatccccaagttttgatattcccataccacttgccgttgtgttccgtttatgtctgaggcgatgacatcggtgtaatcgtagtcaattgagaatttaccggtattctctagtttaagcgttaaattggtccaacaatctgggttatttgctttaaattcttctcttaactcctcgaataactcttgaagttcaattaataaactcacgtaatcagaaactaatttaaatttttccttcgttagtcttaatataatcctctaaaaagtctctgaccgttttcctttttggcagtaaacccaggtttttatacacccaaatagcttttctttgagatccatttagctctgaagcaattacatcttcatagttataatctatagaaaactggcctgtcctatctagattcaaagtcaagtttgtccaaatttgcggattattttccttgtactcttcgcgtaattcttcgaatgattcttgaagttcgattaataaatcatcatagatatcttcgcttacattaaaatggtctggaatgttatgtgaatataagaattcactctcgcccggtatattaaaataaaaatatacttcggaagagtcctctaatatctcggcgtaaagatatactttttcccattctgatggaatcatttcatttatctgatttgctattctttgatacaattcacccatttttggtgtgtccatgatctcaacctccagattgattttttattgttactttttcgaaatcagcatctccaatgctgtacttaacgatgaatttgtctggtcttagtgaatcacctttatatatggcttttatattaacgttaactttttggggtggttcttctttaagagcctttgcccattcttgttccatttcataccatctgccgccgctcctattaatctgagaattcatcggcacgatgttgtcgaattggcctgagcctttgaattgggtggcgattaggtggcctccgtcgtcatctgtcagacggtctggtttacctgcttttgactgtgcatattggttgcgttttgcttctcccagctgcaagtctgctttgacacttgtaattctaccatagttgtcagtcgtgtacgtgtagccttcttttgttttgtagatgacattcggctttaatactttctttctggtccatctcgcaaaatgctcgccgtatttgaccgttaccggcggtacatgcggtgccggtgtccgtctgccgcttgcggaggttccgtacggtttcgacaggatgaccttggcgaatttctgcagtccctctttaagtgtgaccccgttgactgcgttgtaaggcacgcccgccggcactaagtcgtgacgcggatgatacgggagaatatcagccagggtgagatctccgatttgatgtaacttggttttgacacgtttttttgatacttctatgcctgtgtttactttttgtttgatgtgatcaacggtttgttttgagaccgttatcgctttttgtgctgtggcggatttgcttgctgctgttttgactttggttgtcactttggcggctgtgcctgtttttgagacggcgccgacgccttttgtgccgacgactgatgtcacaacggtgcccactgcatatgacacccatcttgctcttgagtaggtgtcgccattcaccatgtctttttggtacgattcttcgattgccgctgaaatggcttcatacgtcttgatcgggtgagccaccgcttctgtaatggcttcaaccgttccgcccggatctgtgaccatatcccataggcctgtgaccgcgtcttttccggaatcataaaggccgacggcaacgcctttgaaaccgtctgtaagttcacgcgtgttttcaatttgagtgaagtagcgctgctgttcttttgtcaggtttttatagccgatcgttttggccattgagtaaaattcatcagcattcgcataatcgtagtttttcagtctttctttcagtttttcaatctctcgttccttcgcttcctctttcttcatcttcaaataagcatccgaatgtcttgcgatatcgcctttcttcttatggatgtcgctttctcggtacgctttggcgttgtagtgaagcggcgtggcgctttttcctttgcctgtggcgttttggagctgctcaaagtcggcttggatgaactgttcgttcgcttcggtttctgcgtattctttc

SEQ ID NO: 119 - DNA, 96331 bp, Bacillus velezensis FL50S
tagtttgactgactacgcacatcgctgtgcgatttatttaaaactttgaattaacaggtacgttttgtcttgtttagttttcaaagatcattataatggagcgggtgatgagaatcgaactcacgacatcagcttggaaggctgaggttttaccactaaactacacccgcatttgaattggcgcgcccgagaggagtcgaacccctaaccttttgatccgtagtcaaacgctctatccaattgagctacgggcgcttatcaggcgacttaactatcatactaccaatcagttatgatgtcaagtgttattttatttcttttcgaagtcttttttctcgacctcatttattatacacgctttcgagaatttgtaaagtctttttttaaaaagatcattttctcatttgtcgttatcgctttgttcatcagcgacgtttaataatataccacgcactttaaattcggtcaacacttttacgaaacttttttcccgcttattattcccttctatataataaataaaaagcaggattcccaggaaccccgcgtctattcagattacccgctcacctcggcttctgcgctattacgatctgttttttcataggtacggaagttttgttcaagctgttcgagcgaaagacctttcgtttccggaaggaaccttttcacaaatataacggacgctatccctaacaggacaaaaatgaagaaggttgcagacaatccgatgtttgcgagcatgaccggaaaagttaaaccaacaatgaagttcacgatccagaggcagaagacagtcacccccataccaagcccccgcaatcgcagcgggaatatctccgacagcatcagccaggtcaccggagagacagccccctgctgaaacgcaaggaaagtgactgttaatgaaagaaccacataaggaagagcaggcgatcctttcagcacgacagacagaactccgatcaaaagcagcaccgcagtcgttccgatcagccccgtcatcagcatcgggcggcggccgactttgccgagaagccatattcccacaaaagtcgcgagcactgaaatcacaccgttagcgatattgccgattaatgcggcttttgtctcgaaaccggcatcttttaaaatttgagttccataatacataattgaattcacaccggtgagctgctgcactaccgcaattccgatcccgataaacacaatgcggcgcacccacggaacggcaagatccttaaaggtcgcctgctccatctgagcttccttatgaaaggcagattcaatctcagcgagctcagacttcgctttctcttcattccttattcgccggagaacgtgcaaagcatcttcttttcttcctttagaaaccagccagcgcggactttcaggaactttcagcataccgaaaaacaagaataccgccggaagggccgcgataacgagcatataacgccaagcgtgagaggtatcaccaagcacattgccgatgatagcattacacgtgaaggcaagcagctggcccgttacaatcatcaattcattttgggtaaccattctccctcggctttccgccggcgacatttcagccaaatatgccggtacggttacggatgctcccccgacggcaagccccagcagaaaacgggagatgatcataaccgatacgttaggcgccagtgtacatccaagcgtcgctataaagaacaaaacggcaaggataaggatatttttacgtctgccgttatagtccgacaatctccctccgaaaaccgcgccgatcgcagcgcccaagagcagggagctcgccaccatcccttcagtcaaagcggtaagattaagctggtcagcttccgccataaacggcagcgccccattaatcacaccggtatcgtagccgaaaagaagccccccgaatgtcgatactaaaatgatggttctcaaaaatgaatgctggctgctatttttattcatcttcaaatcctcctagtttttacacagagataatatcggaatattcagttatcaatatttacacctctaacgtctgcatacaaggtctgaccgtccaaaacagttatataagaagaaaatgttccgaaagcgttatcatttatagtgattattcgctctccccctctcgtcatattgttattttatagttactttgtagtgaagttataatgatattattggtacttatgttaatatcataattttaaaagcgctttcagtcaataaatatttcagaaaattttataactcacctttatatcacctatatataatcaattttcgttttatatcaatttatttccataacatactcaatgaattacccctattataatcaataattgattacatattgaaaacccccaactgctgattgggggtttttgttttattcttcgtttattgtaacaatcgttctccctctcgcttctccttttaaaagggcaggaagcgtatccggcagctcttcaagtgtaatttccttttgaataaaggcctccagatctgcaggcttgaagtcatcagctaaacgctgccatattttctttcttgtctccatcggacagaatacggaatcaattcccaagagactgacgccgcgcaatataaacggaaagactgtagccgggagtttcgttcccgctgtcagtccgctcacagcaactgatccgccgtactgaatctgactgagaactgaagcaagcggctcacctccgaccggatcgacggccgctgcccatttttgtttttgcatcggttttaacgtgccgttatacacttcgtcacggtgaatgaccgtctttgctccgaggctcttcaaatagccgctttcttcttcttttcccgtactggcctcgacctcataacctaaggttgaaagaatggagacggcaaagcttccgacgccgcctgtcgctcccgtcaccagcaccttccctttttcaggagcggcatggttttcttcaagacgctggacggacaatgcggcagtgaagccggcggttccgatcgtcatggcttctttaagtgtcagaccttcaggcagcggcacgatccaatctgccggaatgcgggccatcccgctatagccgccaaaatgggaaacgcctatgccgtagcttgtcgcaatgactttgtccccttctttaaaacgggcgtcctctgaagaaacgacgattcccgctaaatcaattcccggcacgaaaggatacgaggttacgatcttgccgtcaggaatggcagccaagctgtctttataattcacccctgagtagcaaaccttaatcagcacttcaccctcgggaaggtcctgaaccgccagctcccgtacgctgactgaaaaccggtctccatgttgatcgactactaacgctttaaattgatctgtcatcactacgtctccttaaaatgaattgaatggctttggaaaagcataaaataagtttgatttgttttcaaatgtcctgccctgtgtagtatgatcaaaagtaaaaacagcgaaagagtggttacgcatcatgtctgataaacaaaacaaagataacaaaaacaacaacagcaatcagccattaccggacattattcataccgccgttttcaaggcgccgatacaagttgtctgggatacggtctctacggcggacggcttgtctctctggtttatgccgaatgatttcacacctcaagaagacagtgagtttcagctggaatctccgttcggtccgtctccgtgcaagctgctggatattgaagcgccgtaccgcctttctttttcatgggatacggaaggctggatcgtttcttttgtcttaaaggaaacggaaagcggagatacggaattcactctcattcacggcggatggaaagagccggaagccgtcatcaataaagtcaatcggaaaagctccgagattcacagtacgatggatcaaggatggaacgggcttgtcaacacgaaacttcgcggggcggttgaggcttaacacaaaaggacggacacgctttccgtcctttttttgatgccgatacataaaaactgactttgcaaagacactaacagaagaaccgaaaacttctttcagggggcgctgtttatgtattattacaaagaagagctgatcaatatcattaaaccggacaagccggacccggccgcggccaaggtgcttcaggaaattttaggcgggcattacggggaaatgcggacgatgatgcaatactttttccaaagctctaatttcagaggaaaagaaaaacagttccgcgacctgcttcgcggcgtatttttagaagaaattgcacacgttgagctcgtccagcatacgattaatgcgctgctggatgaaagcggcgctgagggagccggaaatcaggcagcagatcaggcgccgcttgacgaagcggttaaacacgccaatccgcaccattatattatcggggcgcaaagttctcttcctgccgatgcaagcggcaatccatggaacgggtcttgggtatacaaccacgggaatctgatttccgatctattggacaatgtcgtgctggaatcaaccggcgtgctgcaaaagacgcgcatttatgaaatgagctcaaaccagacgttcagagaaacactcggttttctgatcgtccgtgacaacgcccatcaaaatgcatttacaaaagcgctggaaacactgggtgtcgaatggggcaaattatttcccgtgccgaattatgatattgaaaaatacccggaatgccggaaattcgttgaaatgggttatcataatacccaatttaatttcagactggatccgacacggatcggagaaattctgcagggaacgacgccgagccgaaacggcggcaaattaagtgtgtcagagcctcctaaaggtttccccgtcccggaacttcccgagcttccgaatgagcacagccccggactgaaagatatgaacttgtaacaaaaaacgcctgtttcgggcgttttttgtttttctgaatatgaggtttgaatgtgttcaaaacggggaatataagccgggagatcttgccatacggccgtgattttgatgtgagcacatttctgtacatacttcgtttcgaaagttgtcctaattttccagccggccggctgggtatgtttgaatgataatgggaattatgtaaagagaacaatgtcttttttaaggaggcagcgaatgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtcacggcagtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttacaccgtactgcagctcacttttatcggggcgatcccgggggataccctgaagcacggatggccggctatcgggactgaattctcccttccgttcaaagatatcgccgtcttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgcgcctccctttggctttcgttcggtctcgctgttttttggacgcttccgttcccttcttggaacgctcttgttaacgtatgctccgtcgcattgattctgtcttatgcgattgcgccgatttcttctgcggcgctgagagtcaacgcgaagaacattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacgccagcagctgaaatcagcttggtggatcgtcggcttttatgtcatgatgctgattttctcctatctcggctcgttcggccacggattgggcattatcagcaatccgcttgacctgattctgatcgccatcggttcgctcggtatttattactgggcaaaatatacaggtctgccgaaggctatgatcgacagtgataaatgacgaatgccggaaagaagtatggtcttctttccggtatttttatgttaagggatgacaaaaaagcgaacatgcgataaaatgaatgacagtcattcataaaaggaggaacccctctattggcaaaacaaagctcgggaaaatacgaaaagatcctgcaagccgcgattgaagtcatttctgaaaaaggattagacaaagcatccatttcagaaatcgtcaaaaaagccggaacggcccaaggtacgttttacttatacttttcttctaaaaacgcactgatatccgcgattgcagaaaacctgctcgacactacgctggacagaataaaagggaaaacggacggttctgaagatttttggacgttgctggacattttggtagatgagacatttcacatcacccggcttcataaagatattatcgttctctgttattccggtcttgccatcgatcattcaatggagaaatgggaagccatttatcagccttattattcctggctggaaggcatgatcaatacggccattgaacagggtgaggtcatcagcggcattcatgtcagatggacggccagaacgattatcaacgttgtcgagaacgcggctgaacggttttatatcggctgtgaacaggatgtcgatctcgaagtatataaaaaagaaatattcagctttctcaaaagaagcttgcagaaatgattggcggagaccgatcatttttgaccgccgtaaaaatgactgacattcattcataactgaggtgactgtatcatgtattggctgcttgtattgatagccggattgttagaagtagtttgggcgtccgccctgaagcatgcggattcgctctttgattggattggcattttccttttgattgccgtcagctttctgatgctgatccgctcttataaaaaaattccgatggctgccgcatataccgtttttgtcggaataggcaccgtcggcacatatgtaacgggcgtcattttaggcgaatcgttttcaatcggacaaatattctttttggctttgctgttgtccggcattttaggaatgaaggtatttacgaaagaaactgaaacaaggggtgaacattaatggcatggctgctgttatttattgccggagcggaggaagttgtagcggccgttgccatgaaacatattgacggttttaaaaaaaagtggccgctgattgtcatggtaacaggctttatgctttcattcttttgcctttccggagcgatgcaggttcttcccacaggtgtcgcgtatgcggcttggaccggcatgggaagcatcggcgtttcggccgtaggcatactttggtttaaagaaaaattcaatctgtcacaattggtgtctctggggcttatcctcatcggtgtcatcggcttaaaactgacagcgtaacggcctgagacagctttttaaataaaaaacaaaggaccctaagcgggccctttgtttttttatgctgttttgatctgttccgcttttcccgctccgactccgaaaatgaaaatcagaacagagactgcgatcagcatgaataacggaaccgtccagccgtgcgtgatgtcatgcagcaaaccgaatacaagcggcccgaacgcagcaagcaggtatccgaatgactgggccatgccggaaagcgccgcggcttcatgaacatgccgggtccgcaggctgaagaacatcatcgccagactgaacgcacagcctcccgcaattccgatcaaaatgacccatagaggagtgagagccgggcttccgaaaagaacgccggcaatgccgataaggaaaaataaagccgtcagtccggcgagtgcgcgctgatttttcattttagcggcagcgatcggcacgataaaagtaatcggcaggactgagaattgcattaatgaaagcatccatcccgccttacttgagctgagtccattctgctgaagaatttccggcagccaagcgatgacggtgtaaaaaataagggattgcagccccatgaacatcgttaccttccaagccagcggagaccgcatcagactgttttttttctctccgtttgtcccagtcgtgcggacgggcagttcgcgtcctcgcatttgcggaatccacatgacgaacgcaataaaagaaaggatagcccagcagccgagcgcgcctttccagcctacccccgctgaagaggcgatcggcacgctgatgccggatgcaatcgcgccgcacagattcatagaaaccgagtagacgccggtcatgatgcctaaatttccgggaaatttatgtttaatgagactcggcagcaggacgttgcatacggcgatcgacaatcccaacaggatcgttccgaaaaagagagtgccgattccggcgatggagcgcagcagagttccggctgtcaggacaattaatgatgacagtaagacaatctcggtcccgaagcgccgggacaataaaggaacaaacggcgacagacatgcaaaggccaaaagcggcactgtcgtaatggtgccggcagccgcattggtcatgccgaggctgtcccgaattgagaaaacgagcggtccgaccgatgtcagaggcgctctgaggttggcccctatcaatatgactccgatgaccagcaatatcagttttttacgctgacttgcttgcagaacttgatgttcgtctttaattttcatgttcatcctccatgtgtattgtatctttaaatactgtgatgtattggttgacggcctccatggcctgatccggtttctgtccgataattgcggcggcaagctgggtgtggatccggatagcaggggtgatttccaacaggttatggactgacgcacaaagcgcctccgtcatatgctcgtatagatcagaaagcatattgttatgggccgcctgtacaattgttttgtgcagcttaatgtcggcttcggcataccgttttcgatcttcattttgcaaggccgcttcacattcatccaagcatgccttcagtgctttcaggtcttcgtcattacgcctttccgccgccaatcgtgcagcttctctttcgagtgcgtatctgacttctaatgtttcaagcaaatttgattttttaatatggcggtaaaatgccgcgccgagaacactggatgagctgacatacgtaccgctcccctgccttgtctgaagcaggccggcatgtacgagcgcccgaatggcctcacgcaacgtgtttcggctcacatcaaattgcttcattaaatccagctcagggggaatgcgcgtcccgaccggccatttatccgattgaattaacgattcaatttgcgccaccacttgttctacgagcgacagtctgcttgttttggatatctccatcaaaacacctctgaaatttgtaggatgattctatcattgggtaatataacataaaagaagcgacgatgtaaatcagcggcaacaaaaaaagagtgagtttttctctcactcttcggcgcttttatgaacgttttatattaactgaggtcacgacaaacttgtcatgacggtggcgggaaaatgaatattcaaaaggagtgccgttgtccaaaaagcctacatgctcgacttcaagtatcgggtcatccggccggcagccgagatattgctgatccatatcatccgacttgcacgctctgatttttctgtgtgtgcccgcgattttgagctgcaatccccgcgtaatatgatcgtagatggaatggttgagcacctcgtcattaatgccgggtataaggctcgccggcatgtacgttttttcaagaacgtacggttcgccttcaacgattctgagcctcactacataatagacgggagtcttttcatcgatagccaaatgtgcggcgacatcttgagacggaaactgcacttcaaaccggatgaccttgctcttgatatttttgccttttaacaaattgctcaagccgagaatttcgttgctgactacgtgaacgtgctcatcctgcatggctgattgaatgataaatgtgccgtgccctctttttctgaaaagcatcccttcagccgcaagtgtatcaagcgcccgcttcatcgtcatccggctgcacccgaactccgcagcgagcgtcttttcatccgggatcggctgatctatgtcatatacactgcttttaatcctctttctcatttcgttggcgattttttcgtacttattcatcggtttcctccggctgtgtaatgtttgatctgtatagactccttacggttatcataaatttttttccctgcttcatcaatgacgttacagccgccgatattgaaattgaaaggatttcctcgaattttctatggaatctccctcactattatggtagaattttttgcagaaacggacacaaccgaatattgcaatatattgtataacctcaatgatatggtttgagggtgtctaccaggaaccgtaaaatcctgattacaaaaattgtcccgtacactttttgtaatcaggattttttattttctaaaaaataaaaaaaggagtatctgtacatgaatttcaaagtatttctgcttgcagcatctaccatcgcagtcggattggttgaattaattgtgggcggtattcttccgcaaatcgcttccgacttagatatatccatcgtcagcgcggggcagctgatcagcgtgtttgcgctcggttacgcggtatccggcccgctgcttttggcagtgacggcaaaggctgaacgaaagcggctttatttaatcgcactgtttattttcttcctaagtaatctggtcgcttatttcagtcccaatttcgccgttcttatggtgtcacgggtgctcgcttccatgagcacagggctgattgtcgtcctttctttaacgattgctcctaaaatcgtggcgcctgaatacagagcgcgggcgatcggcatcattttcatggggttcagctccgcaatcgctttaggcgtgcctgtcggcattatcatcagcaatgccttcggatggcgtgttctgttcttgggaatcggcgtattatctctcatttccatgctgattatcagcgtctttttcgaaaaaatacctgctgaaaaaatgattccgtttcgtgagcagatcaagacgatcgggaccgccaaaattgccagcgcacaccttgtcaccttgtttacattggcggggcattacacactctatgcctactttgcgccttttttggaaagaacgcttcatttgagttccgtttgggtcagtgtatgctactttttgttcggtctgtcagcggtatgcggcggcccgttcggaggctggctgtatgaccgtttaggagcatttaaaagcatcatgcttgtgaccgtttctttcgctctgatcctgtttattcttccgctgacaacggtttctttaatcattttcctgcctgcgatggtgatctggggattgctcagctggagccttgcgccggcgcagcaaagctatttaatcaaaattgcgcctgagtcttccgatattcagcaaagcttcaacacgtccgctttgcagatcggcatcgcgctcgggtcagccatcggcggcggcgtgatcggacaaaccggttctgtcacagcaacagcctggtgcggcggtttgattgtcattatcgctgtcgctttagctgtattctctttaacgagacctgccttgaaaagaaaatccgcataaatgtgagaccgcaaaaaagccaaaggagttccttcggctttggcggtctttttattttgcggcagcaagctcgtcttctgtcacccatttatgattggttactttttggccgccgtcagtcggtgtatagtcgaccatataaacggttgtctttttggctgaatcaataacggcttcggcacccttcatgcctttcatatgggatgcctcgatcacggccttgtcacccggttttaacgttttatcaccggcgcccttcagctcttcctgaatgacccatttgtgatcttcgacgcgctttcctcccgtttccggagtgtaagatacactgtaaaccgttgtatcataagcaccttttacggttccttgcgcatttttcatgcctttcatatgagaagctaaaatcatgacgtcactgccgactttataagtcggattttcggctttctttaaacctttcggcacctcggatgaacctgagtgattcatgtcttcgtgagagtgcgtttctttgtctttcgctttttcgcttcctcctgaagattggccgttgcatccggcaagcgccagaacggggatcaggagaaacatgctgaataaaaatagtctcgctttcatttcaagaactcctttgcctttttgatttttcattttccctttcgtttcttcggtaaaacaaaagaatggcctgtcatttctcctaattcttcaactctctctttattgccttttatcaggtgaaattgttcacaaaatgtacacattaatagagatgcagtataatttaattatcagataatagggggaactcatcatgaaaacgaaggtttttgcggtggtattgggcgctgttttaatgattgcggggttggttttggcagaagtttcgctttatatggaatacatcacaatggtcggagctatgattttttcttctatatttatgtcagagccgaaaagaaaatttcgcgtcatcaaaggggtttgacttttctattaccgccgtcttctcaggacggcggttttgttttgcatgtcagtcagtctatccgcaaagccgtttcttctgtgccgtcctgatataaaacgaaatgcgggacagtttgtgctttatcacctgcaaattcaatttcaagcggcagcgccctgacaaaataacgggtttccgtcattgggaataattcaaatggtgtctgcccgtctattgcaagatacaatcggttttcttttaccgtcaccgatgcatgtgtgtcatcctgaaatgagtaattgccggtaaatctgctgtaaatcgcaggatcgatatctgcttttttctgatccgccggacgtttcggaatcacgtacggctgatcaaataagatgtttacggccgcggcaatcacagcttgttcaaattgatacgattgttccatattgctgagataaatcagtgttttgttctggtcaatataccggatcatcagagttgaatagcccggccagcctccgtcgtgactgataaccttccctttttgggggctgttttgaatcatccagccaaatccgtatccgaattgctcttcttcattccaatagcccggtgtaaacgcttgatctttagactctttgccgatgatttcttccgtataaagagcctgatcaaacagatataaatctctaatagtggagttaacggttccgtcaccttgaatcccgtcaagaaagacgacataatcggtttcctcaagttcatccggcagcacatattctccggaatgaacatcatatacatagccatatgcatagttcggaatgttttctttactcagccttctgttataaatccgcgtatcgtgcatacgaagcggatgaaatacggcttgtttcataaattcagcaaaactcatgcctgatacaatttctataataaccgctaacaccgcataccccgtattactgtatagccactccttgcccggcgggaaataagcatccggtttatgctgcttaagcatatcgatcacatcttgattaacggcaattctgtcccggtcccaatgtgttaaaaataactccatatagtccggcaatcctgacgtatgatggagtaaatgccgaatgttaatgcccggataaggaaaatcaggaagccaccgctctatcatatcgtcataacgcagcttccctcgctgctctaaaatgataacgcctaaagctgtaaacggcttcgatactgaggccaattcaaagaccgattggtcattcagcatcctctttgttttcagttccgcagcgccgaatgaaccctgatataagatgcggccgttttccgctgccaatacagctccgtttatttcatgtctttcgtctaaagtgctgaaaagctgttcaaaagcttgttttttcttatcgttcatttcacgaacctccatatacaagctgatttactcttttatacgaacagccgctttagaagtttcaatattttcccttcccggaacaccagtcagtaaactgccgttcaggcagccgcggaggtttaatgaaggtcttttattcgcacaacactgtgcaggcttcgaactcaacatgcttctcgtctttttttgcgccggcaatttccatagtcgaaaacatcgcacagatgacggctttgtattcgttcatgacggtttgaatttcaatcagaaaccgttcggatgaagaggcgtattccgttacgtattctttcattttgccgataatatcatctgcctgacggatgaagccggccgcctccaagtcactctcaaactggtttttgttgatcatatgaatatgcatttttaaaggcccctttcagcgttttatggttatatccactgtaaaggacaggcttggataaacttttaataaaatatgaacaaaatatgaattggctcatcggcctgaccggcgggcttccggctgtgctccgtttcatttggactacctgaaataatgacttctttactctatgaaaaacagctcatatatgatctaataccagtaaaatgaacgttaggaggcggcctatgtcagcagcaggaaatcggcaaaaattttgggtcatggcgatgcttatagcggtctttgccgtgtttgttttctctttttccgagaatcattcacaaaagaactggcacacggcggttgaccaggcgtcagtgaatgtcttcggccagcagatctttgaaaaagaccgtctggcaaaaacactcaacgcacatgaggcagaatctcttctgactcttgtgaaacttgcaaatgaagaacatcacatcatctaaaagccattataaaaagcctgtttccctttggcagaggaaacaggctttttccatgtattattgagcatgtttttgttcaataaaccggtcgatccgggccagaacatcctgcatgtccatacattctttaaagctttcattaatggcttgaatgccttgtttgtattttccgttatgcagcacttcttccgcggcaagctttaccttttcagcgctcacttcatctttttgcactgtacagcctgcatccaattcagtcaggcggcgcgcaaccatcggctggtctttatcatgcggaataacgaccagcggcacttgataatgaatgccttcatttacactgttcattccgccatgcgtgacaaacacgtcggcctgctccagcacttcaagctgcggcacgtacggggcgatgataaagttttccggcgcctgtttgattttcgacagatcggctttttccccggcggcaatgactacttttccttcaaaatctgagaacgcgtctatgcacagattgaaaaacgcttccgtgtccccgagcaccgttcccattgagatataaatgactttttcattctttaatgagtcaatcgggaagtcgacgcgcccttttctcttcggaaaactcggaccgataaataaatactcatctccgaatgtctcactttcgggctgaaaatatctgcttgtatagacgacgttcaattcacctgtgttgttcataaattgaaccatgctgtcaggggcgacaccgtatttgtctttcatctcggccaacagctcttcacattccctgtccggctgaaacggcacgcccgattccggatggagcggcagtattttcagacggtcttcattgaacaggaaggatgctgaagaagagatgccgggaatgttgagataatcccgcaccagctctcccgcaccgaatttatcataatagacggcgtcgaattgaatgtcctctgccagccgctgcacaatatgtaaaatctccagtgacgttttgatatgaacctttaaaaatgcaagtatgccggacggactgccgggatcaatgggtgtcattctgagcagatcgctgtgaagatgaactttcgctcctactccttccagtctgcttttgtatttttccgttgagatataatgaacgtgatcgccccgttcgctgaaggcctttgtcatacccaaagtcgggtttacgtgtccttctgcgggaaaattgatcatcagaatatgtttcgccatttttcaaactcctttgccttttttgcgtctcttccatatccatcataaatgacgcggaaaaaatcatgcaaggaacattcgtcaggtctttatgacggttcgatgacatcggcaaaaaaagacaaggcttttcaccttgtctatcgtgatgatgcgtctgtttctcccgctttgagcacgcctttcagatgttcttcatcatgcttgagatgctccgtcatatattgcacggcttttgttttatcgcccttttttatttcttcaaagactttccggtgctcatgcaggataacctccgcacggtcatctcctttaaaattaagaactctgcaaaaatgaatcagcacattgacatgctcaagcagcatggccagccggctgttgcggctgaaatccacaaggagccgatgaaacgactcgtttaaggaaataatctcagtctctttgacgcctttattgatggcttcttccgtctcccgcagctgtttttcaatgaggtcaatttcactctcagccgcttcatcaataaccagttcgaccgccaatgattcaagtgacattctgatttgataaatctcttcaacatccttaacggacaaagaataaatgacaaagccgtttcgatcgtctgccgtcagaagcccgtccttttcaaggagccgcatggcttctctgaccggcgaccggctgactccgaaatccttcgccagctgagtctcattcagccgttcacccggtttaaaaatcccgtcaaatatcatttttttcaattgggaataaaactgcagataatacgggattggcttatctaatttaaaattatccatctttcctacctcttcatacaatttaggccttattgttaccaagatcatataacagtttatctatggaagcaacattccagagcttgtcagcataacggaggtggcgtaatatggaattatagcgaacgacggtcgacggtcttccgtaaaccgaaaacaattcattcagaggtgacggaaacatgaaaacatacaagattgccagcataccgggggacggtgtggggaaagaagtcgttccgcaagcggagcgggtgttgaacgcgatcgccgaattacatggaggcattgcctttgatttcacttcatttccgtggagctgcgagtattacttggagcacgggactatgatgccggatgatggattagaaacgttacagcactttgatgctttgtttttgggagcggtggggaatcaaaaactcgtccccgatcatgtttcgctgtgggggctgctcatcaagatacgccgggaatttgaacaggtgattaatgtacggccggcgaagctcctgccgggaatcacttcccccctcgtaaacccgaaagattttgatctgatagtcgtccgcgaaaacagtgagggcgagtacagctctgtcggcggcagaatttatcagggtgaggacgaaatcgccatacaaaacgcggtcttttcccgccggggtacagaaagagtgatgcggtatgctttcgaactggcggcaagtcggcggaaacacgtcacaagcgcgacgaaatcaaacggtattgttcactcgatgccgttctgggatgacatctttaaagaggtcagccgggagtacgccgggatcgagacggattcccagcacatcgatgcactggcggccttctttgtcacgcagcccgaacgctttgatgtcattgtcgcttcgaatctgttcggagatgtgctgacagatatcggcgcggcgattatgggaagcgtcggaatcgctcccgcagccaacatcaatgtaaacggcaaatatccttccatgtttgagcctgttcacggctccgccccggatattgtcggaaaaggaatagccaatcctatcggccaaatatggacggcgaaattaatgctcgattcattcggagaagaggaactgggccatctcctcttacaatctattgaaacggtcacaaacagcggtattctgactcctgatgccggcggaaaacattcaacggaagatgtcacttccgctattatttctcaaatcaagaacagataatacgaaaaaaccgcgggcaggaaaactgcacagcggttttttcgtctcagacgggacggagcgcgcagaaacaggccgattcacctgtgaagcccgcaatacggcctgattgatccttttctacagaaaaaaaccgctgtatatcacaaggagcatccagcatctgtttttccagtaatgcggctttctcttcagtcaggcttgcccgttcacaccagacggtaaattgaaatggtttcaaaaagcagacagcggattcaatccggaagccggctgtctccagaaaacgaagccattctgtttttttccacgcccgaaagtggctctgatcccgtttcttttcaatgtcattataaaaatggtcatattcatccttttcaggtgcggtattgtcaatgagaagcagtctgccgcccggtttgacaacccgaaacgcttcatgaacaaaggctctgacatcgggaaaatgatgcgccgcgattctgcatgtgacgatatcgaaagcagcatcggaaaacggcatcttttcagcatcgcctttttcgaatgacacgttcgtccatccgtttccggttataaatgcttcagcggctgctaacatttcttccgtgaggtcatatgcgataacagagcgtacgagaggagcgagagcgttagccgtatgtccgcctcccgtcgcgatatccagcacgtccatatgcttttcggcaccggaagctgaaatgagatatgccaaatcctctcctgcggcgtatccgggactagtcacatatttcgcggcgtttttagcaaattgccgctgcgcctgctgtttaattgaatcctccattatacttgggcccccttttctttctgcttgctgccttaatcaaaataaacgggttcgtccggatgtttgagatatgcgaacatctttttaatctgactttccgtattgcgggcttcagatagcagcggcagttccgtttccgcaaaaaagccggccgcgcttgtttccgttccctccctgagccggccgccgatgatctcgcatcggataaacactttgtaaacgtgggcggcggacggcgggtgggaatggcatttcttatccattacagctaacagtttaacgggctttacgtcgattcccgactcctcttttacttctttgacagcggtctcgcccggtgaaatcccgatatcagcccatccgcccggcagcgcccatctgccgtcgcttttctctcttaccattaatatgctctgatctttaaaaactgccgctctgatatcaactttcggagtgggatagcccgtgtcaccggcgaatacgtctttgatgatgcttttgtcgatgccggtatgttgcgccatgatatccacgctatttttcttatttcttcaaatctctcaatatcatatatgtctttggaataagccagccccgcttgcgccgcggattgaagctgttttgcccattcaagccattttggctccattttttccaccgcccgttatgttaattaaacgaaacccgaattgcaccttgagagtaccccgtttctgctccttgttttctgtttatggcggagcgaatcctgccgggaaatcagaaaaagccattcatttgctgaatggctttttttcattttctatttttctttcatgacgagaacgacgcctgaaacaataagggccgccccgatccagaaggttcctccgatcgtctctcccagcagcagccagccgagcaatgtcccggaaagcggctgaaagaagaaaaacagaccgccgcttgccgcattcagcaattgtaatccgcgattccaaagcatgaacgcgcaggcggttgagatcacacccagatataaaagtccgccccatatctcaggccgggcaagctgagacaaaggaatctcccgaagcgggcccgctgtaaacggggtcaggatgacaaatgcgacgcaaatggaatacgttgtgacgacaagcggtgagtaatggccgggaacccgtttcatcagcacggacatcaaagcccatgtcagcgccgcagccagaagcgagagaccgccgaactggctcgacatattgagatctccgttccccacaatgagcaatactccgatcgtcgccagccctgtcgatattccttttttcagcgttaaccgttctttcaaaatcagccgggcaaatacaaccataaatgcgggagtggatgccgtaataatcgcacccatctgcgcggttgataatttcgtgccgatttcctgcgtgacgatcgaaatcgtgttgccgatcaatccgatcgcagcgatcagtaataaatcacgtttatgaactttccaggattggcgtgtaaataaactgagaatcaaaagcgaaaaaagcgccaccgcatatctcagccataccagttcaagcggcggaatgaccgctaccactactttaacgacgacatacataccgccccagatactggcggccaatgccaaataaatcgaaccgaacaatgtatttttcaatttgatgcaccctccgttatcatattaggtcacgtcatatgccctaacggagagaagcgcagtcactttcctccattaagggcggagaagtgctgccggtacatcatgttcaaataagggcgctagaaacatatcgtttttcacctcaattgcaatctgatttttctcattatacaaggtttgtcagaagacgtaaacgaacggcggcatcggctttatcgattgcggacttgcagctggattcttgtgatctgattgtcaaacccgtccgccacaacctcatcaagcaaatattcttcatatgcataatcgcccatttccagcccatactcttcaataaactgcatgatgctgcggtaagccgcttccgcttcatcccctatttggtacccgacggcataaagccctttcggcttgatatggaggtcattattctctatgccttcttctgtcttcatataaaaatgggtgtagttgtagaattcttttttcagaatctgctcccgcgcaaacagtccgccgaccggatgcccctgatcgagttcatgtacccgcatatagcggatcaattcggaaatggccgcagtgtattgccgttctggcaaatggagtacgggtcgtcctatcataagtgtctcttcatctaatcgctgcaatgagacggaggagaagtctgtctccaaagcttgttcggtcagcttcacctttgtctgaatcattctttgcaggtgctccagctttttgattttgctttcgatttctgatgatttctcttttaaaagcgtgatgataccctcaggggttttgtctgttaagagcggtttgatctgcttcaagggcacgccgacctccttaaacagaccgataacctggaacagttcgaattgatgataggaatagtatctgtatccgttcgcttttttgatttccggagaaagcaggccgatctcgtcataatggaacagggtttgtttttttacgtggcacagttttgcaaattcacccgttgtgaagtattttctgacgtcttcgctcataatgcctccttgactatacggtaaccatatcctttatgatgatcattgtatccgagagaaggctgattcacaaatggcttacgcaatgaaagctttaccgtctcagaaaaagcagaagaggagtatcaagtatgacgattgaaatcagagcagtcacggaagaaaaccgtgctgatatactggcgcttcatgtaagggaaagccagacttcatttattgaaaccgcggaagagtgcttacaagatgctgaggattgccggcattatcagccggccggtctttatgttaacggggaattggtcggctttgccatgtacggatggtttccggaatatgatgaggaaaatgaaaacggcagagtgtggcttgaccgtttttttattgatgaacgttatcagggacgtggattgggcaggctgttgcttgatgctcttatccgccatctcgttcgaatatatgagtgcagacggatttatttaagtctgtttgaagataacgtgcacgcattgcggctttatcaaaaattcggcttcttattcaatggagagctggactcaaacggggaaaaagtgatggtgaaagagctgtaaaccctctgtataaaagcgattcggcttcttgccaatccctcaaatttgaggtaacataaagataatggacgacggtcgacggacgacgatcgattgttaaaaacctgataaagcggatctgaacatggtgatcaggcatctaaatggaggagaagattgtgcttattatactcgttatgttccttctcgggattattctagggtttatcggcgcggggggagccggttttgtcattgcacttttaactatactgtttcacgtaccgattcatacggctttgggcacctccctcgccggaatggctttcacaagtttatcgggggctttcagccactaccgtgaaggcaatattcagatgaaaatcggcctcatcgtcggcgtttttgcggcattcggttcgtttttcggggcaaggcttacttcccttatccctgcagatttgctgcattacttgacggcgggcatgctgtttttatccgctctgcttattttagtccggttatttattgtaaaagaaacacatgaagattccggacggcaaagcaatctgaacatatgggtgaaagccgttgtactcggtatcatcgcaggaatcttgtccggaacgttcgggatcggctctgcccctttcatccagatcggcttaatgattcttttgcgcttatccatccgccagtcggtcggcaccaccatgcttgtcattatcccgcttgcggtcggcggaggactcggttatgtgacggaaggatttgtcgattatatactgttggtcaaagtgctgatcggcacgatgtgcggcgcatatgtcggagcgaaattcaccaaccacgtgccgaaagtcattctgaaatcagccatctttttaacaccggccatcgccggtctcatgcttttattttaaactgaaacgggaggcggccgcctcccgtttttttctgttcttcacctgttttcgaagagctttttcagctttgcttccgtttcggtatgatctaccggcgtatacacactgcagcgcagatcactgttgccctgaacctgaaatgaagtcaggttaaagaccatttttcccgccttcgcgtggcggaactcaattaatacttcgggtgccgagctgacttcgctctcattccacagcgtatgaaattccgaatacgttttctccatttcttctataaactgagaataccacgtatcagctacatactggccgtaatacgttctgaaaatggcgatgaatcctttcacaaagtgctcccagttcacggctaaacttcttaattcttttctggaaaacaatagctctatgagattccgtttttcaggaggaatttgttcaaaatctaaaaacacgtgagccgcggcctgattccatcccacgatatgacagcgcctgtccgagataatggtgggacaataacggagctcctgcaggatttttgaaagcgacgggctgataaccgcttcttcctccgcggcaaacggctgcttcacgccctcctcaatggcaagcgcgtataaataatttctctcatctttgttgagctgcagcgcatcggaaaccgcgtccaatacggctgcggacactttaatgtctctgccctgctccagccacgtataccacgtggtgcttacgcctgctaattgcgcgacctcttctcttcggagcccgggcgttcttctccgtgtgcccatcggcagcccggccatctgcggagaaattttggcccgctgcgtttttaaaaactctgagagcgcctgcaatcttccttctggtatcataccgaatctctcctctcttaccctggtattcattatactaggataatcaacaacttgtaataggataattgcgagttacaataaatacataccgaaggaggaatgaccatgaaaagagttgtgatcaccggaatgggagtgatttcacctctcggcaatgatgtgcatacattttggaaacacctgacggaaggaacatcgggaatctctctcatcgattcgtttgatgtctccggctccaagacaaaaatagccggcaccgtccgtgattttgacgcagaagaaagatggggcagaaaagaagcgagacggcttgaccgtttcagccagtttgctttagcggcagcggaacaggcgcttgaaagctccgggattcagctcgatcagattgaccgtgaacgcctcggcgtgtacgtcggctcgggaatcggcggcatcacgactttgattgataacgttcatactttaaatgaacggggagcgcgaaaagtgagcccgagccttgtccccatgatgatctcaaacgcggccgccgctcaaatcagcatcagattaggcgcgctcggcccctcactttctcccgtcaccgcgtgttccatcggcaatacgtcgatcggggaagcattcaacgccattcggaatgatgacgcagatattatgtttgccgggggagcggaagcggcgattacgaatttgtcattagccagcttcgggaatgcccacgcgctgtcagcgagaaacgaagaccccgccgcggcaagccggccgtttgacgcggatcgcgatgggtttgtcatgagtgaaggcgcgggcatcttagtattggaatcattggatagcgcaatcggcagaaacgccccgatcctctgtgaggtgctcggctacggcgcaagctctgacgcgtatcatatggtggcctcccatccggaagggacgggcgcatacctggcgatgaaaaacgctttgaaaaaggcgaacgtttcagcggaagacattgatgtcgtaagcgcccacgcgacaagcacaaaagccggagatctttctgaaacattggcaatcaaaacattattcggggagcttgcgtatgacattccggttacggccaacaaatcaatgctcggccacatgcttggcgcggcaggcggcgttgaagccatcgctctgacagaaagcctgagacacggcatcatcccgccgacgatcaatctgcagcaccctgattcggcatgtgatttggactatgtgtcagacgggccccgccatcaatcgttaacgatcggcctttccaactcattcggctttggcggacataattcggcgatcgtgctgaagaaatatgaatagcgggcatcaaaaaaaggagtgaatcatttcactccttttttgctttctccggttttgttgttaaggcgaaaaaagcgatggaaccgataacggatgtcgtgaacataattgcccccatcggcacggccgtcgcttcattcatccccacaagcggcgacacgatggaaccgagaagaagcggaagcatgccgagcagtgcgcttgcgcttcccgcgcggtgtccctgcttttccatcgccaatgtaaaggtgcttgtcagcgtcatgccgatcgtaatcatataaataaaaatggaaatcaccagtgccgccagcggtccgtgaatgatcgtcatgacgagcagaacggcagtcgccgtcatcgctgtaatcacgccgattctcagcaggcttttttcgtgaatgatcccgccgaaacggccgatgataaagcttccggtaatgatcgccagaccgtttatgccgaataaaacactgaatacctgaggcgatactccgtaaatatcctgatacacgaaaggcgttccggagacatacgcaaagctcccgccgtgaataaaaccgaccgtcagcgcatagccgataaatgaccgatccttcagcaggcttcccattgtccgcacggaatttccgatggagctcggaatccgcttttccggcggcagggtttctgtcagcttgagcgcaatgatgagaacaagcaaaaacccgataaaggttaaaaacagaaaaatcgtatgccatgatgcaaacggaagcaataaaatcgcgcctcccgtcatcggcgccaccatcggcgcgacggcggtaatgaccatcagcagcgagaaaaatttagaaagctctcttcccgtaaacacatctctgacgattgcacgggataaaacgagtcctgccgaagcggtgaatccttgaagaaaacgggcaatcaccagtgttgaaatgttcggtgcaagcgcgcaaaacagagaaaacaaagcaaataaaaaaatacatagcaataacggttttcttcttcccttcgcgtcacttaacgggccgacaacaacctgtccgattgtcagtccgatcagacaagcggttaaactgagctggacaagcgaagcgcgggcgcttaaatcttcggcaatttcagggaaactcggcagatacatatctatattgagcggccccagtatcgcaagcattccgagaagaaaagccagcgcaagccgctccttaccggtcggattatgcagcatatcgttcccacctttcctttgtcaatctctcaaaacatttgtatattgtatcataattttttctttatttttaaaagttttcaaagggcataaaaaaccaagggctgtaacagcccttggttccgggtcacgcggtaaaaggttttacgcgtgtttttctttaaatgcttttgcgtattgatcagccgctataatggcatccgccacgtcgtcagccgtcacgtcaaaagcggcatgaatcgtttcttcttcaatcgtcgcggcttctgccactttcataatgtcctctttagatgcgtctttcaatttgatgtcttcaagtgtgacaggcagccccaagctgatataaaacgcgatataccgctcaatttcctcaagcgaacgtttttccagcgccaattgaacgagcgtgccgaatgccactttttcaccatgggtcaagtgatggatttcaccttcaagcgcggtaaatccgttatgaatggcatgtgccgcagctaagccgccgctttcaaatcccagtccgctcagaagtgtattggcttcaaccaccgcttccaatgcgggcgtaacggctttcgctttcacagactcataagcgagacggccgtatttgaataataccgcttcacatttttccgcgatagcctctccggcgattgtcggaattccgcctgccatcgttttaccgccattggcaatgacactgcgcgcctctatccacgtcgccatcgcatcggcaatccctgatgctaaaaagcgcggcggagcttccgcgacgattttcgtatcgaccagaaccaagtcaggattcttatgataaaaacgatagttttcgaacgcgccttgttcagaatacacgacagacagcccgcttgtcggagcatccgttgaagcggccgtcggcacgataacggtgtagccgtttatttcatctgatacggctttggccgtatcaagcgttttaccgccgccgactccgatgacaatagtcgcccctgctttttctgcgataccggcaattcttttcatttcttcctgggaggcttcgccgttgaaaaccgcctcttcagaagagatattgcttttctttaattcagccgtcaccttgtggcccgcgatatcccatacggttttgtccgcgatgacgacggctttttcaccaacgccctccagatgtccgccgatcgtttcaattgcgttttttccctgcacgtatttggccggactgataaaaattcgttccaatgtcatcatcccttcttcgttgtctctcattacatttctcttattgatagagcagaaatgaaaactcttctgatataattcctcgttttaacttggtttaaacctcatatacactgcagaaaatcaattttcacggcattgacaagatgtgaaggtgtctatataatcttcgatattgaagctgatcattctttactgaatgaacaaacgagattgtgaatgattcgtcttaaaaattatttagttctgctggataatttttgaggcgtttttgttttatatatatttttgactgcggaggaggtttgcacatgaagaacatttgcaaggatatactgatgattatggccggagcctttcttatcgcggcgtccgtggaatttttcgtcatcccgaatcatttaggggacggcagcaccgtgggaatcgctctcgttttatattatcttttccatatacctgcaagtattacgactctggttgtaaatttgatttttatcgggctggcttataaatttttaacgaaaaaaacgattttatacacgatactcggtacgggaatgacttctgtttttctcagcatcgtcagctttattccgttcggcgtgcacgacatggtgctcgggattgtattcggcgctctgctgatgggagcggggctggcattgatctttatcgctgacggatctaccggcgggaccacgcttttggcgtatttattgaattacacaaagggctttaacatctccaaaagcatgttttatatggattgtgtcatcattttcgcatccgttttagcgatcggaatcaatcatatgctgtatacgtttatattcgtttatctgtgcgccaaaatcgtcgatattgtcattgagggtttccataataaaaaagccctcaccattatgtctgaccaatacgaagaaatcgccaaagccatcacctccgagtacggcaacgcggcgacgattttttacggatacgggtattacggcagcaaagacaagcgcattatctatgttgtcattaaaaagaacgaattgctgaaaatcaaaaaacatgttcaaaaaattgatccgaaatcatttatcgttattcatgaagtaaaagaagctgtcggagggcaattcgggtttacaaacctgcccgccgccgcaaatgaaaaataaccgcctgcagtgtatagctgcaggctttttttattcggctcttccccgctcaaaggttttttacatctttcaatcgaagtagtaaatgaaaccttttttgatggaggaacataaaaaaatgaatatcaaaactgaaaggctcgtcattcggacatttgaaccggaagattggcaggatgtctatgcgtacacctcgaatccgagtgtcatgaaatatataccagagggtgtctttaccgaagaagatgccaggaaattcgttactgaaaacagcggtgaacatgccgggaagtttcccgttttattgaaggatgagaaaacggtcattggccacattgttttttttcagtattttggcgatcatacgtatgaaatcggctgggtgtttcacccggaataccagggcaaaggatatgcttcagaggcggcgcgcgccgtgctggcattcgggtttaacaagatgaaattacaccggatcattgcgacatgtcagccggaaaacatggcttcgcaccgggtgatggaaaagatcgggatgaggcgggaaggcttgtttaaaaaatgcatcccccatgataatgaatggtgggatgaatattattatgccgttttagaagaagagtgggaagcctccgatctggaataaaaaggcttataccctttgcttttacagataagtgtgtgctacactgttcgtaacaaatacgaagggatgatgggtggacaatgattaactaatcttattttgaccgtttgaaatcaaatatttcaaatcagaaaaaataggattagtctgcccattttctatacgatacgagaaagctatgtaaaaatagcttatttgatcacgcacaggtacggctaatccttccaaatcaattgggaggatttttttgtcctccctttaaagcgagggattgacatatgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaagctgatggcgtttattctggaggagaaagatgtgctgattctggatgagccgacaaaccaccttgatctgccgtcacgcgagcagcttgaagacactttggcccgatacgacggaacgctcatcatcgtatcgcatgatcgttactttgtcgaaaagacgacggacatccggcttgatatctcaaacggcagcgtccgaaaacaatggaaagaatctccctccgtcagagatgatgctgaagaactgcgattaaagcttgaaaccgaacggcaggaagtcctcggaaaactcagcttcatgactccggctgataaacaatatcgtgagcttgatcaaaagttcaaagagctgacggaagaaatcaagaagttgaaatgaatgtaaaaacccgtgattgtcacgggtttttttggaaagttcacgtatcatgaagaataatttcaaactgatttgtacaacctacgttcagattcatacgagaaggttcagaaagaaaggttcaggtgaacgcagaatggccaaacgcatcggaattacgggaaacattatggctgatcaatccggccctttcccgggttataatcgggcatatgtcaataatgattatattcagtctgtttctgaggccggcggtgtgccgtttatattgccggtgattcaagagacggcgcttttaaaggaacaggtctctcatgttgacggcatcattctgtccggcggccaggatatagatccgctgttttacggcgaagaacctttacaggctttaagaaagacctttcctgatcgggacgcctacgaaaaggagctgattctcacggcggttgctttagaaaagccgatactggccatctgccgggggatgcatatgttaaacgtcacttacgggggaactttatatcaagacctgacacacgcttcgtttgctgacattaagcatgaccaagaaaaagatccgccgttaaaaacccatcatgtttcttttgaaaaagggacacgtctccataccttgtttggcgattcagcgcgggtgaattcattccatcaccagatcataaaagagacggcgccttcatttaaagccgcggcttatgcgaaagacggggccattgaagcgattgaacgaacgggtgaattatttgtcgtcggcgtgcaatggcatcccgaaatgctgacaaaaaaacatgaagacatgaaaaagcttttttctctgttcatgaatgcggtcagcacataaaaaaagcagatcataacgatctgctttttcattttattcttccggtttctccggtgttttgccttgtgtcagcttatggccttcgatatccacgttcggaatgattttatccagccacttcggcaagtaccaggccgcatgtcccatcagcttcatgacactcggaatgatggtcattcttacaatgaacgcatcgaaaagaacaccgaaggtcattgccaatcccatggatttgatcgtagagtcccccgcgaagatgaatcccgcaaagacgaaaatcatgatcagtcccgccgctgttacgacaggtccgctatgtttcaatccggcatggatggcttgtaccggattttttgttttgacatattcttctctcattctgctgacaaggaatacttgatagtccatcgccagcccgaaaagaataccgatggctaaaataggcaggaaggcgagaatcggacctttttccggaatgctgagcaagccggtgaaattcccatcctgcagaacgaataccgataacccgagtgtagcggtcatcgtcagcaaaaagccgacgacggcggcaagcggcacgagaagcgagcggaaaacaacggtcagcaatacaaacgcaaacccgacaataagaatggcgaattccggaatcgcatcgtttaaccggtctgaaatatcaatattcaccgctgttgacccggtgacgagcaggcggatgccgtttttgtctgatcgtttccgtatatcctgcactaactctttcgttgccttatcattcggcccggtttcaggcactgccgtaatgatggcataatcccctttttgattcggcatggcaggtgtgacgctcgccacattgtgcaagtcctttatttctttcacggcgtcttgaaatgcttcacttttattccccttgactccttttgcatcggcaacaattgtcagcttgccgttaaagccttcgccgaatcctttagacaacagatcataggcgcggcggtccgggctgtctttcgctttcattcccgcatcaggcagccccagctctaaatgcatggccggcagactgatgacggctaaaagaataatgctgaaaatgcttaacagaataggcttctttgtaacgaagcgtccccaggcattcgtgtcggcgcttttcttttctttcttcttgtttgatttcggaatcatccgttttcctgcgattgacaacaccgcaggaaccagcgttactgatgccaatacagccatcagcacactgagtgccgcagtcaatcccatcgcagacatgaacggaatgccgacaacggtcaatccgcaaagcgcgacgatcacggtcagtcccgcaaaaacgacggcgctgccagccgttcccgcagctttagcgatcgattcatttttttgtacaccttcgcccaaaaactgacgatgcttcgtaaagataaacagcgcataatcaatcccgacggccaggccgatcattcctgataatgagagactgaccgaggctatcgtaaagatttgtgtcccaattaacgtcagcgcgacgcttacacctaacccaatcagggctgtgacaatcggcagccccgctataactaatgaaccaaacgtaatggccagaacgacgaaagccagcacaacgccgacaatttcagagacaccgccgacttcaacaccggcccccggcacatcgccgctgagctccgtctgcaggtccttgtctccggcggcggacagactgtgtttaatatgtgaaacagacgcatccgtaatgtcatccgccgcttttttgtacgtaatatcggcatatgccactgatccgtctttagaaatggttcctgtttcaaaaggacttgcaatcgaagcgactgaatgatctgttttgatcttctttaatgtctcttcaatcgcttgtttttccggttttgacgtcaatttcttcccgtcttcagctccgaaaataacccgtatgcttcctttatcggacccctttgaaaattctttttgaatgatatccatcgccttttcagaaggtgtgtcgggaattgacatatcctcagaaaaagcaggctttaacgagatggcgatcacaatcgaagcgatcaatatcacgagccacgcaatgatcattttgaatcggttgcgggcagaccatccccctaatttatataaaaaaccagacatcgaatactcctctccaatcattactttctgcctaattgtagttcacattcacataaaaaaaacgtacataggggcatgtacgtttgggcagtttttcattatatattcagtttcagaatgcctttttgcatggcaatggtgacggcttccgtccgtgaatcagcgcctaatttgttataaatcgatgttaatctcgcttttaccgtccgctctgagattcctaaatcgaaggcgatcgctttgcttttatgtcctttcgcaacggcttgcagaactatgatttccttgtccgtcagctgtgtttcattggcatttgcccgttccattttcatttcccggaaacggcgcaagatgtccggctgcagaagcacttctcccctcaccgccgcatccatcgtatgaaataaggtttctgagcttgtgtccttcagcagataaccgttcgcgcctgattcgatgccttctatcatcagatgatcttcattataggtcgtcaaaataatgatcggcacatcagaatgctcttttatctgtttaatggcttccagcccgctcatttccggcatgtacagatccatgagaatgacatcgggctttagttcctctgcgaggcggacggcggttttcccgttttccgcctctcccgttatggtgtaatggtcatttgtttctatcaaaagcttcagaccttctctgacgacaagatggtcatctgctattaacactttatacatgttccgcttctccttgaattggtatgatgatctcaatttgagttcccgctgatctggcgcttgttatacggaaagtgccgttcatcatattgacgcgttcttgtatccccagcagcccgtaatgtccgctttttctcatttctgttccggcatcaaagcctttcccgtcatctttgacggttatgcggatctgtccctcttcttcctgaacggacacccagacattctttgcttctgcatgcttggcggcgttagtcaggccttcgccaatcatgtaaaggcaattctccgccgtatgaacgtcaagcacatgatgcacgctgtaatctaaaaaacaagacagcccggaggcttctgtaaaatggttgatttgttcagtgatgctttcttttaagaacccgatctcttctgatttgctgcgaaggttgtcaatggccgagcgcgcatcagccaatgtgcccttcactctgtccattgactggctgatgatgtctttcgctctgtcagtgttaccctttgaaagatgaacatgcaccgcttcaagctgcatatgcaagctgaccagcccttgtgcaagtgtatcgtgcaagtctctcgccatccgctgcctttcgttttgaagcgtcagctgtttcacttgccggtgagcgagctctaatttttcaagcgtcatctgtgttttgattttttcatcaacttgcgcgaaaaatgttgccgcatatgtgataatcacgatcatgatgggagcggcgataacgatgaaacgaagcagatgatgcggatgctcctggtgcagggctgctatggacattaaaatgaaaagatagagtatgagcggcgttttgcccttatccgccattccgataatctgcccgattaaaaaggcatagagaccgatgaccgccgcgatatagccgccggtcatcaagttagccgatgtatatatgataaatccctgtatgatgaaataaagaaacgtttttttcttgacccagcgataggaatgccagtgcagcacagcaaaaatgacgatcaatatcgtgaataacagcagcaataaaaccgtccagctttcataaatgtactgcaaagagactgatgcggcatataccataaaaataaacgccagaccgggcacccgaagcgcaagcatatgcaatgagcgtctgtcacgggagacatagtcttcttgatgttttgtaccaaacaatctctgtccacttccttttagccgaccggcctcacgatgttttattctatttgtcatcataccataatcgcctgcttctcaccttccccttctgtcctgcatgacgggtgaaagaaaaaacagcctgcgggattgttcgcaagctgcttttgttcatatcttttttatgacctttcccgggtttcagcggtctcgtctcccgcgagggcaaaaccgcccgcgcatcagaaaaacgttcaggacaccgacagccattccatgtgaacaagaggaggcgattgtgcttcctcttttttaatgtaccgtcggatttcttctctcttttttataaacaaaatttgtaagactagagctcttttctcaggggaaattaattatgtaattgagaagaggaggtttaaaagacgattatggaaaagcgtgaattagcggctcacgagtcgctggacttacatgaaatcattaacttcaagacgctttgtgtagcgaaatccaagctcatgcaagggcttgtgtttgatcaggatctgaaaacgttaatggaaaaagacgttcagcaagcctcgcaaaaccttgctgatctgcaggcggtttatgaacgggcaacgtttcaggctcctgttcctcaaaaccggccgacttcgatcatcaattgaaaggaaggtaagcatcattgaaccatgaccatttagatccaatcaattcattacacgtccctgaactcgcagatatgacattcgcaatggattttctcatacgcgcaaaagaaggcgtcagaaataccgccgtcgctttgacagaaaccgcctcgccagatgtaagagctttgctgcgcaaacagctcatgcaaggaatcgcgatgcatcaggaaattacagacttgatggtcagcaaaaagtggtttcacccgcatgatctgagcgaacagtataaactggaccagctctctgcgaaaaataccctcatggtcggaaacatgaatctgtttcccgttgaaacgaacagaaaagggatgtttgaccgcacacctgatgaacactaacactggaggtattacagcatgaaggccgtaacgtatcaaggagtgaaaaacgtcgtcgtcaaagacgtgcctgatccgaagattgaaaaacacgatgacatgattataaaagtcacaagtacggcaatttgcggatcagatttacatttaatccacggactcattccgaacttgcaggaagactatattatcgggcatgaaccgatgggcattgtggaagaaaccggtcccggcgtgacgaaagtcaaaaaaggcgaccgcgtcattattccttttaatattgcctgcggagaatgcacttattgtaaaaatcacctggaaagccaatgtgatcaatcaaatgaaaacggcgatatgggcgcttatttcggctattcagggagtaccggcggctatccgggcggccaggccgaatatttgcgcgtcccttttgcgaactttacccattttaaagtccccgaaacatgcgaagaaccggatgagaaattgagtgttattgccgatgcgatgacaaccggtttttggagcgttgacaatgccggcgtaaaagcaggcgatacggtcatcgttctcggctgcgggcccgtgggccttttcgctcaaaaattctgctggttaaagggtgcgaaacgcgtaatagccgtagactatgtcaactaccgtctccagcatgcgaaacggacgaataaagtggaaatcgtgaacttcgaagaccacgaaaatacgggcagctacctgaaggaaatcaccaaaggcggcgccgacgttgtcattgacgccgtcggcatggacggaaaaatgacggacctggagttcctcgccagcggattaaaacttcaaggcggggccatgagcgcattggtcatcgcgtcccaagcggtgcgaaaaggcggaacgatccagattacgggtgtgtacggcggcagatacaacgggtttccccttggcgatatcatgcagcggaacgtcaatatccgatcaggacaagctccggttatccattatatgccgtatatgtttgaactggtgtcaaccggcaaaattgacccgggtgatgttgtaagccatgtcattccgctcagtgaagcgaagaacggctatgagatgtttgacacgaaaacagatgattgtattaaagttgtactcaaaccttagagaacggaggctacagaaatggccagcgccttacatgaattactcgaaattcaggagatggcttcttttaagtcactttgcctgacgaaatccaaaaccatgaaagcgctcgtatccgatccgcagctgaaagaaatcatgcagcaggatgcggatacatcaacaaggcaattgcaggaatttgcctcgattttatctgatgcaaagcacgaataggagatgaatgacgaatgaatccgattattgaatacctgacggggatggatgcactgacagaccaaattgtcgctatggatttattgaattcggcaaaaagcggagtcagaaactatgcgatggcggcgacggaagccggaacgcctgaagtgaaagcgatcctcacccgtcacttagaagaagccatcgacatgcatgagcaaatctcacgctatatgatggaaaaaggctggtatcatccgtggaacacagatgaacaagtccggtttaatttgcaaaatattgatacggcgctccgcctgcccgtcctataaatgctttcctgctgagacagcacctctggctcagcttcagtatgtcaaactgagaactgcctttacagcgcccaggcaacgaaactcccgcgaatcagctctgcagcttctccagcctttcttcgggctgttattggggcttgcggcggtgattacgtgcgtggcggccgccgggcggttcgcaaatagagcgaagaaggcagaacaatttgttctgccttttcattattttctgccccataggcacaaatacttttcacccgattcgagcggcggttattcacgtagcttgaactcccttaaacgcactcatcacaagatcatgcacataggaatcattcacctcatcacctgtgatcaacaggcgatagaaaatcggtccgtaaatgagatcgatgcttacgtcaatatcaagattctctcttaattcacctttctgaattcccttttccagaaggcctttcgcttggaggcggcggggctggaaaaatcgcgtgcgatattcttccgccaattttgcatccagctgtcccgcaccgattaattccttaataacggttccttcccggctcgtcaaaaaccttgctaaattcgcggcgtgggtcaatatatcttgcactgttgatcctgtatcgggcacaggcagtctgtccgtagcggtcgaaagaaagctgtccatgataacggcagccttgtttgaccaccatttataaatcgttgccttactcactttggcacgctctgcaattttatcgactgtcaccgcgtcaaagccattttccaacaataggtcataggcagcagaaagaatcgccttatgtgttccttcatcacgcggccgtcctcgtttactctgcacatgaatcattccttcccgaattataaacgatacgttcagtatacttaacctgtataaaaaaagaaaacagaaacccatttacaaaactgaacgtttagtatattattcacttataaacaaaactgaacgtttagtttataaaataacttgagggaagtcttgatgaaatgcagactccaaaagcctctgcgtaaaggagatgaatcagcaaaatatttatcaaacctcataaaatcattaaaaaggagttcattcatatggctaaagaaaataaacaaacagcggatcaggggatttcaactggtttaacccttcttctcgcaacggcatgcggtatcattgtcgctaatctttattatgcacagcccttggcaggattcattagtgcggcaatcgggctttctccaagcagtgccggattgattgtcacgctgactcaaatcggatacgttgccggcctactgtttctcgtccctttgggagatattatcgaaaacagaaaacttgtcgtggtatcgctcctactaagcgcagccgctctaactctgacagcatgtgtgaagcatggaacactgtttttagccgctgcgtttttcatcggactgggatccatcgcggcccaagtgctagttccgttcgcatcataccttgcaccagatgccgcacgcggccgggttgtcggcaatgtgatgagcggcctgcttctcggtattatgctttcccgtccgatatccagtctggtcgctgatatatgggggtggaatgccatatttgctttatccgccgcgttaagtgttgtcctggcaatcgtcttatcaaaagtgcttcctgccagaaaaccaacagcaaacacaagctacaccgtcttactcggttcaatgtggaagctgctgcgcacgactccggtcttacgccgccgtgccatttatcatgcgtttgtatttggagctttcagcttattctggacgactgtacctttactattgtccggtcctgcttttcatttttctcaaaaggcaatcgcgctgtacgcattagcgggcattgcgggtgcagcggctgcaccgataggcggccgtctggctgatcgcggcttaacccggcttgccaccggaatcgctctcggtgttgtcatcgtttctttattactcccgctcatgattcagagcagctctcccgtcggaatagcagttctggtggccgcagctatcctgttggatatgggggtatctgccaatctcgtactcagtcagcgtgccattttttcgttggcacctgaattccgcagccgattaaacggattatttatggcaatcttctttctgggcggcgctataggatcatcaatcggaggatgggcatacgcctcaggcgggtggagtatcacattatggattggaatcgcttttccggtcatagcattgctttatttcaccacggagaaataagcctttcaccaaaaataagccgtcaggaccaagctgacagctttttttggggtgtattcttctttacatccatccgaacaaaacatccggattcatgaaaagatgatattgattctttacgccccgctcatatagacgggcgcatgcccgctgccgattctttcagcagcggtaaaaccatgtcataatatgtttagaaataattgtccataggcaggtgaaacacatgaagaagtatttatataaacaccttttgttagctctcgtttcgtccgtttgctttttattggtcttttatgtgggtttaaaaatgacacaggaagacacacccccgttgtcttcttacccgttttacctttttatttatctttacatagcagccggatatttgacggtcggccttgtttcagcctgtatgactgatatcttgaaaaaccgctggacattgaataaaacgtcttccattctattgaaacttatcgtttacttactcataccgtatgctatttttcattctttcttcattttaatggcgccgttgatttatgtgctgttcgagtcgttattcatcctgagaaaagcttcataatcagaaaaaaacataccgcatgctgccggtatgtttttaacatgcttgtcagttttttgcggtgatccgtttgatgttttcttccatcaagccggaaatgagctgttcgtttgtatgaggaatctgtttgagctgttgtacgaccagcccttgtcttgcggctgaatgattttgactcagctttgcctgtccctctattttgctgattttgattttaaaaccttttacccctttgttcatgcctgccagcaatttcgcatcgacatcctctaatttgtacgggctgtcggggctttcgtatttcaatacgagatcactcatcgactgcacggtttcttcctcatccaaaagctccgcctctccgtaaacatgaaccgccacataattccatgtgggaacagcctgattcgtctcataccatttaggcgagatataacaatgaggcccctgaaaaacggctaatacgttttggccatcaatctctttccattggggattcggcaatgcaaaatgaccgtataagcattcgttattcttactcatcatcaatggcaggtgggttgcatacggcatgccccccgccgttgaaaacaatgctgcgaaaccatactctttgattacatcgcacgcttcagcttcactcagctgaaatggagccggaatatacatacaaaactctcctctctgaacatggattgataaagcgctttccgctataataaaatatcaactgacatttaaaaagatacagtttcaaataaatacacatgtcagaggagaacatctgatgaaaaatttgattttcgctttcagaagcggcaccccgaaatacaaacaaatttacgagcaatttaaaacattgattgagcaaggaaatattcaggcagatgagcggctgccttccattcgcgagctggcggattccctgcgggtaagccgcaatacaacgctgatggcctatgatctgcttttagcggagggatacattcgcggagaaacacgcaaaggatattttgctaatgaaatagaaccctctttatttcaacaagaacatgatgttgtttacgctgagaaaaccgaatcaactcagccggccctgattgattttcgcgccggagccgtcgatcaaaagcattttcctctgaaaacatggagaaaattatacaatcaagttttggcatcagagaaaagctttctgtacggtgaaccgttcggcgagagaaacctgcgtgaacaaattgccgcttatctcttggaatcacgcggagtgaaaacagatgcggattcggttatcatcggcagcagcacccagcagatgctgatatatctcagccagattctgaaagaggatttttccggaattatcgttgaagaccctgggtttgacggtgccagagcggcatttcaatttcacgggctatctctggaaacgatgcctgtctatgaaaacggagctgatttttctcaattgcatgcaatgaaagaaaaattaatctatgtgaccccatcccatcacagcccttacggcgtaagcatgtccattcagcagcgccaaacactgatcaattgggtgaatcatagagagggttatattcttgaagatgattatgacagtgaattccgttatacacagcagccgtttcccgctcttgcttccattcaatcagaccgggtgatttatttagggaatttctcaaaatcctttctaccgggcatccgcataagctatatggttttgccgcagcgccttttgcaccggtataaaaaacggtttattcatttcgaaagcaccgcttcttcgcttaaccagctgaccatggctgaattgatgaaggccggtgaatggacccgccatattaagcgcatgcgcactgtctacaagcgtaagatgcagcacttgacttcacatatcaagcagcagttcggcgatcaggtgacgatcatcggcgagcagtcgggattgtatatattagtaagagttcacctgaactatacagaagaaacattaatcgaacgcgcctttcagtacggagtgaaagtataccctaccgctgtctatttcgttgccggaaagcccgaaccgccgatcataaagttaggtttcgcccatctcgatacggatcagatcacacagggcgtacagcttttgagaaatgcttggctgtcatgaaagaaaaaaggcgccgaacggcgcctttttttatcttttatttcgtatttcttgtgaatttcggcagtccaaatataatggcggcgatgccgcagattccgattaaaacgggatagaaagagtatggcaggatgctgacgggtgaaatattcccgaatttcccggctgataacagctgcgcgccgtaaggaatcaatccttgtatcatacacgaaaagatatccagaatacttgccgattttctgttgtcgatgttgaatttatcagcaatattctttgcaatcggcccggctgcgataatcgagatcgtattattggccgcagccagattcgtcacgctgaccaatccggcaatgccggcttcggcgccttttttggaacggattcgtttcgtgatgaactccagtaaaaagtcgatcccgccgttttgtttcatcacaccgaccattccgccgatcagcatggacaggatgataaggtcgctcattccggcaactccatccgtaatcgctttaaaataagaatcaaacgtcaggctcccgcccgccaatccgatgattcccgtcaaaaccaatccgccgaatatgacagccatcacattaataccgattaacgcaaaaactaacacggcgacataaggaagcaccttaatccagctgtaagatgcagcatccgtatggagggcgtggcctgccggaataaaaaataagataataacagtcacaatggcagcgggcaaaacaatcagaaagttcgttttgaatttatccctcatttgtgttttttgcgtccggactgccgcaatggtcgtatctgaaataaaagaaagattatctccgaacatagctccgccgaccacagccgcaatcggtatcgcgctggagatgccaagctctccgctcaaaccggcgctgatcggcgcaaccgccgcaatcgtgcccattgatgttcccatcgatatagaaatgaaacaagcaatgataaacagccccggcagcaaaaactgctgcggaataatgctcaaagcaagattgacagttgaatgcaccgctcccatcgcctcagccgctgaagcaaaggcacctgccaatataaaaatcataaccataatgataatatcaggatgtcccgcaccggaagcgaaccattctattttttgattgagcgatttcttccggttaaataacagcgcaaaagctgacgcaatgatcgcggcaatcaagatcggcaatttataaaaatctccggtcaccagaccagagccgacaaaaagccctacgaataagactaaaggcaataacgcccaaggattcttatgattgttcatctgggtaaaccacctcttttcagcattaaagtcgctaatcacagtctaagcaacatttcacactttaaaagtctgcagtaaaaaagtcaagctgaaaaaaggataagtaatgattgataagatagaaaaagctgttttgtttcctctctttagaaaataaaaaaaccaaggctcgtttcccttggtacatttcatgcggcccggcgcccgggacaccttctcttcattcagaaatacattcagctttcaatctgtttttaagtttcgcttcattttccaggatatcttcgtaatcctcaatcttcctgtttaatcgttttatggtttcatcaatttccctctgtttctccgtcagccttttcctttcatttataaggatgttttttcggggttcgatcgtatgatcggctccttcaataaataaagcggtatattcaatcagagcctcaatcgacagcccggcacttctcatgcattttataaattgaatccaattcacatcaccttcgtcataatcgcggatgccgctttcatcgcgttttaccggaggaatcagtcctataccttcataatacctaagcgtcgcggctgataactcaacctgctttgcagcctgcgcaatcttcatattcttaccacccatccttcatacctttcataagcgtgccattatagaatatcatttcataaaaaaatagaccaaaccccttgacttaaagtccgctttaacatttaaagtaaaaccgaacagaggattcatcactttatcttggaaaggaagataaccatgtgcaataatcatcatccgactcgtgtattaagcgctccgcatgccaaagctaaatttgagcggacgacgattgagagaagagcattacggccgcacgatatcctgattgatattaagtacagcgggatttgtcactcagacatccacagtgcattcgatgaatggggcggcggaatctttccgatggttcccgggcacgaaattgccggagttgtggaagccgtgggtgaagaagtcaccacatttgccgccggtgaccgtgtgggtgtcggctgttttgtagactcctgcggggaatgtgaatactgcctgaacggagacgaacaatattgcacaaaaggcgttgttcagacctataataacctggactacgacggaaaccctacgtacggaggctacagccagaaaatagttgtcactgacagattcgttgtccgtattcccgatcagctggatttggatgctgccagtccgctattgtgcgcgggcattaccacctattctccgctgaaacactggaatgccggtcccggcaaaaaagtggcgattgtcggaatgggcgggctcggacatttagccgttcaattcgcgcacgctttaggcgcagaggtcaccgtcctcagccgctcaatgaacaaaaaagacgaagcgcttgaatttggagccgatcattactttgcgacaagcgatccggatacatttactgagctggccggacgatttgatcttattttaaatacagtatccgcgaaccttgacgtagatgcctacttatccctgcttcgcattgacggtacattggtaaatgtgggagcgcccgctaagccggactcatatagtgtgttctccttaatcacgggccgccgcagcattgcgggttcactcgtcggcggtattccgcagactcaggagatgcttgatttcgccgccgagcacggcattgctcctaaaattgaagtgataccggccgatcaagtcgacgaagcgtacgaacgggttctccaaagcgatgtccgctaccgtttcgttattgatattgcaactttataattctcataaaaaacataccaatatctattggtatgtttttttcagcgcagattattttttatttcagcagccatccgggcaccgctttgatataaaccaattcaccgatcagctcaacaatcgtctgtgtgacgataacagcagcggctaatgaggcccaagcatccggcagagccagcgctagcggaaggactgcgagtgaattccttgagcccgtgctgaagatcaatgctcttccttcacctgtatccagacggaacgcatatgcgataaaacgggagacaaacggcataatgagcaggaatagcagatagatcggaatcacacgtataatgatgtcagcatcattgatgactttgccgatttgtgtggcgacgaccgccaataaaaccagagccataaaaggaacaggcagccacgccgtccattccaacaccttttctcccgccggtttcttatcagcccataattgagtcatcaccgccgccagcagcggcaccgctattaacaatgagaatgcttccagaaacggtcccgcatgaacagcccctatcacttctttcccgataaacagccacaggtataacggaagcaataccatctgaacggcgaacaaaaccggcgtggaagccaatattaatctctcatttcctttgccgagctgagtaaagacgatgacgtaatcaatacaaggtgtaagcaataccaaacaaacccctgataatataggaggagattgaggaaaaatggcggttaacacccatacaacgacaggtacagctaagaaattaccgatcagtaaagccgccataaacttgaggtttgacatggcttccctcagctttaagaatgggatttgggcaaacatggcatacatgagaacagcgataagcggtgatatcgtccatccccagcgaagtcctgaatctttcccggcgatccccgctaatccgccgatcacaagagtcgcaccatatatccaaatttgctgtttttctaatgtctctctggttattttcattggctgacacctcttctccgcccattataccttcttttctgccggaattaaaaaacaccaagggtctgtgacacttggtgttttcaggacgtgttattgttgtcaaaaccgcttacgaaagcttacttgtgttctctgtcctgccaacgaataaggtgaccgcaacactggctgaactgaccaaagttcccaggacggcagcaagaattgtcaaaaagccattgggaatcagaaatccaatcggaatgaggcccgcaaacgtgagaacgataaaacattgatagactccggatatgattctcacaaccaagctgctaaaaaaggacatgacgaatggcggaatgaacaaacataaaatgattccgagtgagatcaataaaatcataggctcgtcaaaagaaatgacacgattgccgggagactcttcagccgccgcgaatacagcaaatatagacatcatcagcgtaagaaaaacaagaaaaaaccttttcagcaacgttatgactccttttttataaaaacgggtatctttttttcaatcacaataaccattttatgttatcaaatgaaataatatgaagtcaaaccgagttctgcacctgatttatcggttcttatttttttgataatttccatataattgtccgcaagcagcatctatatcaatgccaaattgacttctgacggtcacgttaattcctgctgactttaattttttatagaagtttacaacttgtttctcatttacttcttcaaatctcataggtgaactaacagtcgggttatatctaatgatgtttacatggaacaagttccctctcttatatctgcttcttaaaagacgtactacttcattcgcatgatcaatagaatcattaactcccggcagcataatataagcaatataaacttttcttgaggtcacacgtatatgctcatctaatgtgtccattacctccaataacgggaagcgttcatttatcggcattaacttgcttcgctgttcattaaaaggagaatgtaatgaaaacgtcaggttgacctgcggataatcctgagtgatttttttaatgcccggaataatacctatggtcgaaatagataaccgacgagggcttaaagcaaacaactccggatttgtaagcacatgtaaagcatcaaaaacttgtacattcgctaatgcttctcccattcccataaaagaaatactatcaattgaatgtccttttaagtgaaagtacaaaatttggtcagtcatttcatctgatgttaagctgcgttttaaaccaatatctcctgttgcacaaaatgcacagccaaaatgacagccgcactgcgaggatatacaaaatgactcccagccagctttatatttcatattgaccgtttctattttttcgtctcctgaaatttcaaataagacttttgttacttgctcagaatgctgcacttttaaagcagcaatatttaaaattgactctccaaactcattcattaacaattttctcaaggatttaggaagaaccgttatttcattaaaatgatttattctccctttgaacacagcatttttgatttgattcattctaaaatcaggaaacttattttgtttcaggaactcttgaattcttatatacttgtttttttgttgcatgttttctcatccttccataaaactctggtttgtttgagtaaatagaagggagtgatcatctaacctttttttaaaatcaggcacaaaaaaacaccgacacaattatcggtgttacgcttaaataacatcatgcacaaataaacaaggacattatgtcattggattatcgtttatttgacatagagaaaaagcaccgataactgtttttgtatgatgatttggcttaaaaaaggacagactgctccctttatccgccaagatgtttccaatttttgcattttcaccatacaaaattccataaatcgttatcatcgctttcacctctttcttgtcaatattaacaataatcaccatatcataagggttcccttatgtaaagttaaacaaatgcttacgcccccgctaatgacagtattataaaacttgcttattaagcctaatccaagtacagaaagcgcgctgatcacatgtttcacttatccgcgacggaacatttcttatataatgggtgaccggcagctgcctgcttgaatcccaatcttcttatagtgattttttatattcatgacagtatgatgatttgtcacttcagcaatcagatcgtttattcgatccagattaatcggtttattttctgataagctgctgaagctttctctgatttcttcaggatagacatttccggccatgcttgacaggccgttacacccgttactcagcatcttcggaaattcaacgtctcctgccgcaaacaaaataaagtgatcagggaactctgtttgtttatgacgcagaacgtctcctccttctttcagcccccttatcccgggatgccggcttattaagtctttaagcgctttctcactcagattaaaaccggtccggccggggttattataaagcacagcctctttagaggtatgactgagaagttcgtcaacgtaataaacggcttgctgctgtgtcggtcttatataaggaggaaaaccaatcagtacagaatcaatattggttttctcgatgtgtttcatcagtttgacggcatcactggttcttacggctgaaacaccgaacatcagttcaacatcttcaaattttcgctgattaacatactcaatgatctgaagacgctcatctatgctgagtgaatgctgttcaccagtcgtgccgcatatgagtaacgaatggataccgctgtttttcaaatgttcgacaatagcatcaaatccttctaaatataaactttcatcttcatgaaaaggcgtagggatagcaacattaaaatttcgcatgagaatgtcctccaagtacatattcttgaatatctgcagagtatcatataacactgtctgacatttaaaaaggtacagtttcagataacgcaacatgtcagatgtaaagccgacacacaaaaaaagcaggcaaagagagcctgcttcatagcttcgtcttacagcggcccattccccggatggcttgacaaatatgagtaataaggcaaactgatatgaaaattgtgctaatgaggtggggttaatgattttagatttaaaaggtgaaacgcacatggatcatcttgtgggaacgctgtattctgccgttaatgaaaatgacagccgcttaatatccattgtgtcagacatgtcacagcaggagattgattataaaggaccaaatcatcaaccattcaatggggaatatggcatatggcagaccataatagatatcatcaagctcatattcatcagcttcgcaaatggtatgaagagaaacagaaacttggcagttaaagccgcttattaggaggagcaacgataaattcattacaaatgtctattttcactgactgccaatcaattaaaatggtcagacaaaaatcgctattacatttgcaacgtatcttaatccggccggcgcagttgtaataaaaaaagaccgctttcccctcttcttcaacgtaactgacatcatcatcttcatttttcttaacataaggttcagcaaatcgttcctcggtatattccacacattgctttcaaatgcaggtgcaattctccttgaaacagcaaatggttgtttggtttattgaattctttcatattaaaaaatggagtcattttaatgatcatatcagtctccttccaaacgagattgcatttacccattatttgttattctgcaactgaatcattatcttttatatcaggaattcttacaaaaaagtaaggtaagtgtaaggtattcgcatttattcgatatgcagtgttcattagaataagaaatataaaaggagtgatgaagaatgaaaaacatgagcattttcattattatattaggctgcctatcggttttcatattaggaggctgcgctgatcaaggcgccgtgctggaaagcgattattacgtacaaattcacggaaaagcggaaaaaaacaaaaataatagcaactacgtttacaatttagaagggtataacgagaaaggtaagaaaaagatggtttctttctttgttgaaaagccttatcaagaaggtgacattgtacgcgttccgaggagctatgagggttataccggagaatctgaagctattaaggccgagaaactgcctgaaaagatcaaagaccgattcaacattgagaaataacagcgagttgagcagatatttaagtctgctctcaattttttacgacaggttcattcgaatgcaaaatgcaggatggctccttgggccacttctacataaaagattgtgcaaattaagcacaccctccccattttctttttttggctggttacaactatcggaagtggcattgacaattcttctatggtcccaagtaattaatgaactctatagtgggcggatacgtatacggcggggtttgcagttttttaacttcttgttatttgagctatttcgacttttacttgaaagaattaaattagagagtctgaacgaggagtgaagcacgcgctccatgtgaatccatttagttcaaactgaatatgcgcggactaaaatagttgcactgatggacgtattcaacacaaaaaagagcagtaaacacgtaagttactgctctcctcagtctatccgccgttcatttgttttacaatgtattcagcatcatttcctacaccttgaagcagcgctgaacctcgcctatgctgccaaggcaaaccaataaagtacaatccctccgcagctgaaacaccccggtgatgtataattcggccttccttatccaaaacaccttctattttcatccaccaaagcggattcttaaaaccagttgcccaaataacattgtttacttctaatgaagatgaatctttaaaaatgacttcattttgctttccggctatgactctttgttttaagatgatcttcttctgtcttattgcatgttttaattcatacccaaatatgaggtcgcctttcttttgaatgaacttgcctaatattgatgtatgacttgcatgtaaagctcctaatttatcaaaccaccaaaagatgcttctttttccaatccataaagggaaataaaccggttttttactgcaagccaaatatgtaactctttctttggataactcaacagctatctgagccccgctattcccgccgccgactaccagtacattcccaggcgccagttgttttgaatgtttatattgtgaagaatgtaattgacgaatatgaccggctacatcttttgatattgatggaatgttaggggtatgaaaaggacctgcggccaccaccagattcttcgtttgatattcttcccggtttgttttaattaagaaatagttgtttaatttttggacacttattacttctgtccgtaatcggatcgggatttcaaatctttcaacatattttttcagataagcagcaatttcattttttgaagggagtccatgctggtctccttcaagctgcattcccggcaaagagctgtacattcgagaagtaaataagaccaatgagtcataccggtttttccagctttcccccacttcatgacttttatctaaaatgataaacttttgtttcgacttccttagataatatcctactgagattcctgcctgaccggctccgattactatcgtgtcgtacatatgaatcccccctccggttttatcttaattgtcagcagacaaagtgagtccctatctcctccttaatgatgatgatggtcacgcggattctcagtttgggcctgacaaagaatcgtattgtcgtgattatgcgctgccgtttccatttgaatggttacatgtgtaatgccttgatctccaagttcatgttcaattttgcgtaaaatactttcactttcagaaatggtcagctgatcgttaacaacagcgtggcaggaaagagcattcaatccgcttgtgatagaccatatgtgcaaatcatgaatgctttgaattccttctgtctcttcaattgtatgaatgatgtcagtgacatcgatattttccggagttccttccattaatacgtgaatggagtctttcgtcacatggtaaccgcttctcagcacaagaatagccacaatgacactggccactggatctgcccagctccacccgaagaagatgataaggatcgcagccagtatggcacctacagatccgagcatgtcacttatcacatgtaagtaagctcctctaatgttcaggttattctttgtatctccgccgttcagcataatccaagcgaccaatatattcacagctaacccgatgatacttatcgtcagcatgccggttgttgctatctccggcggatgagagaaacgtttgattgcttcataaatgatataaagggaaatcagtattaatgcaacaccgttgatcacagctgcaagaatttcaaatcgtttgtagccgaatgtcttatgatgacttgcctttttttcggccaatttaaaagcaatcagagcaaccattaatgagattgaatcactcagcatatggcctgcatctgacaaaagcgctaaactattggttaaaaatccgcctatcgcttctattatcatataacctgtaatcatgataaaagagatcaataaaaccttcttattggatccgccagcatgattgtgattgtgacccataaaaatctcctccttatctaatacgctgtatttattatttcttttctgctatgaagcattctaacatggacacaaaaataaccatatatgattatgtgctcatatatgaatatataggttctttactgaaatgtcaaaatattttcaatgaaaatgtttcttatcattagcttagcttgggaggttgcattgctatgaagccgcggattacagtaattactttaggcgcagataatttagaaaaatcgctgcacttctatcgggatggcttgggtctgcctacagaatacagaaggaacagccggtacagatttggacgacttgcaaacgggactgaaacttgccctctggaaccgcaaagacatcgcacatgaatcaaacattacgataactgctcccgctcatgatactttttggggcggatacgccggtcacttccaagattctgacgggcacttgtgggaaattgtttggaatccgcactgggaatataagtgaataatcaacttttatagcaacaataaaaacacacctgaatgttctggtgtgttttttattttgtttcccacaacgatcaaactatttatacgatggcgggatgctttgcggaaaacggaatacattttcgggatcgtatttcgcctttattctttgaagccttgcaaagtttgagccataatatgcttttccgaaattttcaatattttgatccggaacattcacatatgaacctgttacatatggtttcatcagctgacgcactctttcaactgatgcaagattcgaagcttcttgtgatttatttttccaactggccgtccattccgtataaaataacggacggcgccaatagaaggctgtttcactgcttggaactctgcttatcgcaccgccccaattgataaaaaagaaattggtttctgtcccagtcgctttttctaaaaattgtctcattactgcaataggttcttccggccaaagattgagcgcccacgccgaggagaatttaacactctgatcagacctgccgggaatcggttcatcaggatctaagaaatctatacaatccggatagtatagtgttttgattactgtttgtgccggcgttccggcatttaataaaggttttaataattgaatcagctccggttttgacccgaggaacaatccttccgcatggcacaaaccatttactttgctgtaaatctcaaggtagcatcctaatcgttcgtctgtaaacggcgcccatttttgccacgctttgaataccgtttctaactgttcccacggccaaataatattaaagacggttgcggttttaggggcacggtgaactttgaacgtatattgggtgttatatccgaaattgcctcctccgccgcctctggaagcccacagtaaatcttcattgcgggaatgatttgcttgaatgatcctgcctttggcatctaccattttcagcgcgagaaggttatcacttatcaggccgatcgatcgtgaaagcactccaaatccgcctcccatcgtgattcctccgattccgacggttggactgtctccgaacggggccataaaaccttcccgagctaaaccttttacaagcgggccgacgtgaatgccggtttgaacggttgccaccgcgtttttttcatctaagaaaacgttattcatgtcactcacatcaataacaatcccatcacttaccgtggaaagatttttatccagagcatggcggccgcttctgacacgcaaaggcacattcttctcacgagcccatttaatagcattacttacatcgtatgaattttgcgcaaaaacaaagacaagcggacagacatcaacataagggttccaattcttaaccgcctctgtatagccggggtcccctttgaagatgacgcgtcccgttaactgtgctgatcccatctatttcactcccaataagcatttgattccgataccagtatatgtaggaattggacaaattcttagacagatgttctgcaaacttaaaaatagatacctatacgcgaagatgagaaaaaaacaaaaaaagacaagagcggcaagctgccgaaactcttgtctctcctgccatgataggcacttacatttattggcgtgatatcccgaccaaactatggaagtccatagaacattatgtttgccctgccatgcgtggttctgctgagcaatctttctgtttgatcccccgacaagaatctttttctttatcgtttttgcacccctgtacggataaaatcaatacacattgaatcttatcttttacatgatgaaaagctcttattttttcttcttgtgcttacgtttgcaatcatgttttttctctttcttatgacgttttttacatttcgcttttgctttggctgctaattttgccgcttctacctttgcttcagctgctgcttttgctgcttctgccgctctggctcttgcttcttccgctcttgctatggcttcttccgctctggctctcgcttctgcttctcttgccgcttccgctcttgcatcgtcgtccgccatatcaaaatcatggccaaggtcacaggcctcgttgtatggctttttcttctggacgtactgttgatcgtcaccttcgttataatacattacgccactccttctctcgttttttaatctctacatactatgtaaagaaagaactgcagcttggactggtattttgatgaaccggcacattttttagggcaattttcatttatcattgcaacagaatctggatgcctgcatgaaacttgaatgattttgacgattatcttaagcagcgtaaaaagggagactacgaaaaaaccaaggggttaaacccttggtttttttgtaaaaatgataaaaaggatgctgcacgctgcagcatccttctgtaccaactttttattgaacgattggaaagtattttttagcttttagtttgcttgctgtgtttgttttactggttctttgctaaaaagtccgacaatgttccacaagataatagcagcagctatgattacacgagccgtactgacttcttgattagtaaacaatttatagccatatattgatcccaatgctgctatgcaaaaaatattgaaccatttactccaacgcaattagaaaactccttataaaagattacatttccaaacaatgtattataatattaacaaattttttcaatatttaaccttaaattattcttaagtgtcgttcaagtaaaaatcattattactattttgtttttttcttgaagaacgagtaccttaccccttcaccctccacaaccattaatcaaagtacgggattatcagtatattgttccctgattgttatacagcgcatttcctttcataagctttttaatcccttcggtgtaataaggcaatcgttgacttgcctgttcaatatcaacccattctattttcaatatttcttgagcatttttaatcccttctttccctcctgtaacttttgcttcaaatgaaaaaatatatggcgtgatgatttctctttataaatttcgcttcattaacagctagtatattcccaatttcaacttccagccctgtttcttcatatacctcacgtacagctgcttctattagattttcattaagctcaacttttccgcccggaagtgaccaatgcccctcatgattatttgccattactatctgattgaactcatttctaatcaatgcgtatacaactttaacttcttccacatgactctcctttactaaaaatattttttaaccgataatttattttccatatatttactacaaagaatataaagggatataacagctatttttttgtaatacatcaaacttacaaccgttcaaacgcatcatttgtatcgttttagaaccttttttaaaaacgacagtctattgagcagagcaaataagagtaaactttaaaaataaaagagaacataaaaaataccaaaggccgttacacccttggtatcattgagatgcagccgggaggacttacgcttcatgggtttttcaaccacgggagcctcgcactgcttttaaacataagatactattccttacttccaagcgaccatatcaccaccggaattaataataacgataatatccctccgccaagtgataatgtcaggtaaccggcacctgctacgaccattccggacaatgctccgccggcggctccggacaacgcaatcaaaacatccacagtaccttgggttttagcccgtgttgacgtttcagttgaatcaacaatcagtgccgttccgcttatcaaaccaaaattccatcctaacccgagcaaagacagagcaatgaccataagaatcatagaatctcccggtgcaaatgctgatatgagccctgccaaaagcagcgtcattccggaagatacagccattacagtacggcctaatttatccgcaagcacacctgtcaccaaagaagggagatacatggcgcctatatgaaaaccgataacaagacctaccgctcctaagccatggccgtgatgtctcatatggaccggtgtcattgtcataatagcagtcattacaatttgagtaagaatcataaccgccgcacccgcaataataccttttttgttctctgtgtgttcgtcggcggtcacttgtcctctatcatcaggtgtttggccggcaatttctattgttcttgctatgactaaagggtcaggacgtagcatgatgaaaagagtaacacctgccaacatatatgctgccgccgctaaaatgaatggacccgccagtgacggaacaccaatggagcgagcgaagttccccattacattcactaaattcgggcctgcaacggcaccgaatgtggtaaaaaccatagtcatactgacagcagtcgcccgctgtttatgatttgccaagtccgtacccgcataacgggcctgcagatttgtcgctgttcccgcaccataaataatcaaagaagcaaacagcagaaacacactatttaaaatagccgcaatgatgactcctatcgctcccagtccgccaatcataaatccggctgaaagacctgtccggcggccgtaacgctgagaaagcctccccacaaataacgcggcgcctgctgatcctaaggtaaataaagcagagggcacaccggcaaacgcatctgtaccaagcatttgctgtgcaataagcgcaccgacagtcactccggccgccaaccctgcgccgccgaaaatttgtgaaagactgacgacaaacaaagtacgcttatataatcttttttgtttatcagaagaacctatgaattgctccaataatgccgattgagtatctgacccttttgcactgtctttgtgaagcataatccgacctgcctttctataacctccaacagatttggattatcataacacgcacaaaaaaaccatacaatatagtaattgtatggcggacaatattagataagctcatccagcaggcgtttaagaatcagcagtccctgctcaagctccccaagcgttttcggtgcacagacagacacccttacagccctttccggacaactgttcccgacgacaaaacgttcagccgcgtatacttgcactccatgctgtgcggctgatttttcaaatgcagcacctgtcatatttccgggtaacagcaaccatcgaaagattcccgtctcagcacctgcacacgtatagccgtttaaatattgatcgatcattttgtttctgcgaatagtctgttcacgatgactgtcaattaagatttcaaattgattcgatacgattgtgcgtgcagtgagttctgctaacagcggggaaacggttatatttaaattgtaaagcgcctttgaaatcggctccttatattgactcgggacggcgacatacgccatccttaaccctggtgccagtgattttgataaaccggcaatgtgaatgacctgttccggtgcaaatgatgcgattgccggaagcggattcttgccaagaagatggtacgaggcatcttcaataatgaatcggttatatttttttgcgattttcgcgatcatttttcgattctcaacagacataaaggacgctgtcggattatgataatccgggatgaggtagatgcctttaatattttcatttttacacgcgtactcaaatgagacagggctcatttcattgttctctgatttgatcggcacaatttgcacactcagcattgaagcggccgttttcaagcctgggtatgtatggtgatcaactccaatgcggtcacccggtttacaaagactcgccaatgccgcggcaatcgcattttgcccgccgtttgcaaataaaatgtgatcaacggacgtttcaaatccgcctcttcgaatcagcttaacagccgcatctttatgccaaagactttcacccgtccggccatagccaaaccacttttcataatcttcctcttgcagcatacttttcagctggagcagcagcggctcataagaagcctgatccggaagcgtcgcccccatttcaatcagatgcttcggctttgtatcctccagcagatacgcattcgataacgcatcataagcaacaaatgtcccgctcccgacagaggcactcagcagaccctttaactcgcagactttaaaagcctttgaaatggtgcttacatttaaatccaaaaaatcagccagttctctctgaggaggcagtttggttccgggtaataaaacttcttgtaatatatcctgttctaatttctctgcaatcgctttataaatgggtttttccgttttatcaatcgccggcttccagctcatcggatagttttcaaaagaattgatcggcatgatatgcatcctttttcattcaattatatgatcacaccgtttataaaacaattttaacagacgcaaaagttgacataaaaaaagccaaaggcggttaaacctttggcatgattgatacgccgggaaaaattgaactttcatcagagatatcaatgatgagaagggcttttctgtacgacactctctatcttcactctttatctcgatttgtattccttgatgttcccgtttccttagttagaagaaagatcactaacgacatctaataatacattgacacctgcagccaagtcatgatctttcgtgtattcttcaggattatggctgatcccctctatactgggaacgaaaatcatagccgtcggacagatgcgggccatcatttgtgcatcgtgcccggcaccggatgtcatccgttttgactccagtccgcgtttattggcagcccgctcaattaatgcaacaatgtttttatcaaatacaacgggattgaaacggactaattgttcagatgtgatagatacgttttcagcctcttccaaatctttcaggtaatcgtccagtgctgattcttcttcttgaagtctcttttcgtccggatctcgcaaatcaactgtaagtgctgccaatgatggaatgacattgatagcatttggctcaaaactgattgttccgaccgtggcgacagtttggccgttagacatattggcacgtttgcgcaaatacgttatgatttgtgcggctgcatgcccggcatcctgacgcatatcagtcggagttgtcccggcatgatttgaaacgccttgaaccgttatacgcttccaggaaatcccttgcaaattctcaacggcaccgaccggaatgcctgttttgtctaaaatcggcccctgctcaacatggagctcaataaaggcgtgcggtgttaaaaagccgggcttttctgttccctcatatcctatacgtttaagttcttcacccagtttcgtcccatccgtaccgcgggtctgaagcgccttttctaaagaaagtcctccggcgaatacgagtgatcccatcatatctggagtatatcgcacaccttcctcattggtaaaagccgccatgacaatcggacgctccggtttgaagccggactcctttaaagcgtttatgacttcaagtcccgaaataaccccgtaacatccatcgtaaatacccgcgttgatgaccgtgtcgatatgagagccgatcataatgggcgcatcattattctgatcagaaccgtaccataccccgaaaatatttccgattttatcaatcataacctctaagcctgcttcttccatccatgttaccaataagtcccgtcccgccttatcttcatcggaagcagctaaccttgtgagtctgtcattgcggtcacgtccgatttcaccaagctccttaagacggctgagtaaacgttcagaattaatgtaaaggttcacatgttcagatgccattttgcattcctccctgtactgagtcaatcgcttcatagatataacaataatgttatgatatatgagaattcatcatcttaataccaatattggatttaaaaatataagtatattgaggtgtttaacatgcaaacgcaaaactttctgatggatgacagtctgcaagatttgacgaaacaccatacaattgttatgccggttgcttgctatgaaaaaaccattaagaaccatttgcacggatatattccccttcattggcatgatgaaattcaattcgtgcttataataaaaggagaagcgctgttccaagtaaatgaggaatgggtggttgtccgtcaaggcgacgggctgtttattaacagcggctgcctgcatatgacaaaggagcatggcagttcagattgtctttatatctgtttaaatgtctccccgcatttcgttttatcacaggaactctacacgacctatgtaaaacctttgattcacgcaacgaatgtcccttacttatatattcacgcagacgaccctttagaaaaaaatattctgaatgctgtattagagatccacaaatgcatcgagcaaaaatcacccttttatgaaatagatatcacgatgaaacttacgtctgtttggaaacacttaatcgccaattgcttccaccttgaatgtatcgaaacagaatggttgaagaaccaaaggatgaagaatatgctgagctggatccatcagcattatgctgaaaaaatcacattggaggatattgcgaaagccgggcagctaagccgttctgagtgctgccgctatttcaagcgctttttaaaatgttctccgttacactacgttatagattacagaattcaaaaaagcttatatttattgcagcaaagagatgcgagtgtgacagacatttcttatcaagttggttttaacagcacaagttatttcatcagcaggttcagacatgccatgaagatgacgccgctggcttataaaaaacaaaaaaacaaagaaagacagcactgactgattcagtaattgctgtttttctttgtttcatgtgttttaggataagcgaattttaactaattccgcaaaatacgctgcaccggttaaaagaatgtcatcattaaaatcatatgacgggctgtgtaatggaatatggcccttttgatcatgctcatccccattgccaagaaaaacaaatacaccgggaaccttctctaaaaaagccgagaaatcttctgaaatcatcatctgatttatgttagaagtgacattctcttttccggctgttttggcagcagcttcaacagtaaacccgacatattcttcccaattcgtcgttggagcaaattcatgtgtatactcaaactgacactccgcaccatgcatctcacaaatcccggtactgatagtcctcattttttcttcgagaaaacgtcggatgtcaggagaataactccgcgtatcacctttgatttccacataagtcggaatcgcattcctcaccccgtctgttacgatttccgtacaggatataacggcaggaacgcttggatctaaatttctggacacaatagtctgtaaggcgagaataatttgcgacgctatgaccaatggatcaatactcatatgagggcgggctgcatgagcgccttttcctttaatccggatgacaaagttatcttcaccggccataattcccccggggcgggttgcaaaagtacccgccggcaatccaggcatattatgcaatccgtaaatttcatcgagcggaaattgttcaaaaagtccatcctcaatcatagccctcgcacccttgcccggttcttccgccggttgaaaaataaaacacacggtgccgttaaaatgttgtctttcactcaatattttagctgtcccaagaaggattgccatatgtccgtcatgaccgcaggcatgcattttccctttatttttagacacatacgaatgatctgctgcttcagtgaagtgtaatgcgtccagttccgctctgattcctataacctttgatccttctcccgcttttaaggtggcgactatacctgttccgcccagacccaaacaaacgcttactcccattttttttaattcttcagcaatatacgctgaggtcatgtgttcttcaaaagctgtttcaggtatcatatggaggtcatgtctccattttattaattgatctttcattgtgatatcattcataaagaccactccaatataatcattaaatagaaagcgtttacaaaaaataattaaaataaagcaaaaataattgccgaaacagtgatgacaccaataatcgtaacaaaaacattactgattttatttcgatacatttttaatactggcagcttacgaatggcatacatagggagcagcaatagaataacagcccctatcggtccgctgatgctttcaatgatgcctagaatacttgggttgatataagctattagccagcaagtgacaaacataaaaaacagaatgataaaatctgtttttttcttattatttcttgatggaaaaacctcaacaatgatatcccgcatggcctcgtaggctcctatataatgtcctaaaaaggatttcgtaattgcgacaaatgcgataatcggggaaagacaagcaataaacactgaatgaaaatggttggcgagataagtgagaattgagatgttttgtttctttgccatagcaagatctgccggcgacaaactgaatacacagctgtatacaaaaaataaaacagtaagtatcatcaatatataactgtatttttgtatttgagcacatttatcatcagcaaatttgtctccataacactgcctttgagctacaacgaatggtgaaatcattgaataatgattaaatgaaagcaccaggacagggaatgtcatccataccgtcatgaacatcccttgtcctgatccggataatgataagtgtgtgacatccaaaatggctgtattccatttaggtatcagatagatccccatcaaacataacgaacctataaatggataaactaacaaactcatagtcttcatgaccgcatcctgaccaaaacgcacgataaatagtaatcctgctatcagaaatccggcagttaaaccccttggcggctctgacatgttcatttgattcacaataaagctctgagctgtatttgtaatggcaactgaatacattaacaggatgctgtaaatcgcaagaaaataaatgacagtgaatactcttcttgctttcgctccaaagtattctcctgtcaccgctaaaatcccgtctgttgcagaacctgctgataaaacaaatctggccaaagctctgtgagaaaagtacgtaatcggaaaagccagaacagtgatgatcatcagaggcagaatgccccctattcccgcattaattggcaaaaaaagcacgcccgcgcctattgctgtgccaaacaggcctaagacccaaattgtattttgcctgcaccatttagccggatcttcataagaggcattattcgatgaagaactccggcaccgcacatccacatcctgttctatagacatatttatcctcccgaaaaaagaatgtcatgctctggaatatcacgaattaccatgaagtcgggcagcttttcactcgtatatatttatccggaatacgcgatgacttcaatttcaatctgtacatctttaggcaaccggcttacttcaattgtggatctcgcaggacgatggtctccaagatatttaccatattcctcgttaacagcttgaaaatcacctaaatttttaaggaaaatagtcgttttcactatattttcaatttttaaatcctctgatttcagaatggattcaatattttttaaaacttgaatcgtttgttccctaatatcagccggaacttcatccgtgtttggattaacaggaagctgtcctgataaaaataaaaaatcttgtactttaatgccttgagaataaggtccgatcgcttttggtgctttttctgtgaaaactgcttttaacataataatcaccttctccttattgatataagattcaaaatattcttcacgaaaaaactgaattgctttcagttaagagtaatatatcacatatctcatattagtcaaatgaaaaattcatacaaaaaagcctgacgagttgtcaggcttttaattggctgtttaaaatgattcgagtcagactgttttcccaattactccttatggcattcagtccttgtttaagatctttattcctcattgcgtctaatatttgatagtgttcactgcaggatgcattcattgcgtgattttgactgaaataccgaatttcaattctctgtattttcgttttttgtccttgcagtaatttctgcagttcagtattatttgagacttcaatgatcttttgatgaaaggcattatccaattccagcgcttttaccttatcatccatctccatgattgcattcatttgcttatttaatttttccatctcgtttatatgatcttgcgtaaatcttgaaagtgcctgttcaaaagcgagacactcgagagaccaaacgaccgagtaaacctctttcgcattttccaggtcaataggtgctaccactgtccaccgattggctttcgttatgacaagaccttcattttcaagctgaagcagcgcctcccggaccggcgtgcggctgattccgagtgtctcagatagatcttgatttctcagtctttctcccggctcaagcttacctgttataatccactctctcagaaactgataagcttcaactttcataaatgttcgttttaattggtgctgttggttcattgtcacgtttccacctctttaaaacatcattttacatgtaatataccacatttcagtatatcgtttgcgaaaaagaagagttgctttacattccgatccatgtataatgtgatatatcacatattggaagggtgaagaaatttgtttgcgaatattgattgggtttcgaatcatttcagatctgatacgttacctcaggaatcttcctatttctctgcagaggaaacaaaaaaagcgcttcattttcattccggcattcccggctatcaagcaacaccgcttcactcgttaagaggtctcgcacaatatctcggcataaacagtctttatgtcaaagatgaatctaaacggtttagccttaatgcttttaaaagcttgggtgcttcatatgcgattgcttcttactattgtgaaaaatttagaatcgaccttaattccattcattttaacgaattggttgaatttgtaaaaagcgctccttctgctacatttgctacagctaccgacggtaatcacggaaagggactggcatgggcggcttctctttttggacagagagcaaaggtatatatgccgaaaggttcttctcccgcgagattggaagccattaaacatttaggtgctgatgcgtacattacagatttaaattatgatgacactgttcaaatggcggcagatttatctgagaaacatcattggattttagttcaggatacggcttgggaaggataccagcaaattcctctctctatcatgcaaggatatacaacaattatggcagaaatatacaaacaaaatgaagatttcttcaatacaatcagtcatgttatccttcaggctggagtgggatctttcgctgcttcaatggcagcttccctattaaatgtaaaaagcgggaataagcccataatctccatagttgaacccgaaagcgcaaattgtctgtaccagtcagcccaaagcgcctctggatcacctgtccgagtatacggtgatctttctacaatgatggctgggcttgcctgcggcgaacccaacccattcggttggaacattttgagaacaagcagtgattatttcttttcctgtaatgacaagataagcgcattggggatgagaatattgggtaatcctattgattcggatccaaagattatttctggtgagtcaggttccgtaccattaggtttgctgcatgagttaagtagaaatacttcaatggaacagataaagaagaaattagaattagatcagtcatctaatgtgttaatcattaatacagaaggtgatactgatccggaaaattatcggaaagcggtttggggaacagatcattaaaacaacggcaacatgtttgttttaacaatttataaaaagccttaactttgggtgaagttaaggcttccgttatttccccttcccgtgtaaaactcaatcatttaactagtcccaaattaaaggcctgtcaacctcagcagttctgaggtagtctaaaagctgacccgtatgtacagactcatggtaagcgattcttaataacatgtctcccagttcgcgaatatatccaacatcagacctgtcaatctttatatttgttaaatctgtttcgtttaacgatttgatgaatgtcaaaaacgcggcccgatacggttttgcaaattctaattcttcgcttactgtggtaaacgtttttgattcataaggattaatagtttcctctgaaaactcactcatatttttcattaaaatctgatgataaagaaattccgcttctaatacatgtcttatcatttccttgcacgacatggcttcggaatccgggcgccagtccattttttcctcaggtacagctgtccataacttgatgcttcgccgtcttacctcttcaaaatgtaaaacaataaggtcaattgtattcaagtattttcccccttttatttttaaataataattctccttcttcccggaaaaaacctcttcaaataaaaaacatatcctttcccgactcgacggattgataatcaaaccatttttaagataaagagatattcattcatccatacaatagactctggctgaacatatactgaatgatagttttcatcagaaaggagaaatcagctttggcaaaatatcggatcatgacctttgacgggggcggtaccttaggtgctttaagtttacaactattgaacagactggctgaagaaaatccggcattaataagccgaacccatgtatttgcgggaaattcaatcggttcatttactgccttggcattagcaagcggaagatctccgaaggaaacacttcagtattttgaggatgaaatcctgcccgcattcagcacttcccggccgggcggacctgttttcaatcagcaattaccctattccggttttattaaagcggtacgaaactttttcccgccaggccttcgtcttaaagatgtaagaaaacgaattgttgtcccttcattcaaattatactccccggcactggatcgttggacgcccgtattatttcacaactttcccggctctccctatttaaatgagaaagtgagtgatgtcatactgcggagcagcggtgctcccgcgacacagcgcgcctatcaaaactacgtggacggatatgtagtggcaacgaaccccagtacggccagtatcgcgtttgcggttggtaaagccaacgtgccattggatcaaattgcggcgctatccatcggtacaggtgaagccccgactcggttaagaagagatacgaggggatggggaatggtaagtgcggataacatacgtcccgaaaatctgaagaaccttcctccaaattggggagtccttttggacaggtcgcctaatgaacctttactgccatttcttcagatgatctccggcggaaatggctactatgaatccatggtcagcgcgaatctgctgggagatcgctttttccggttagatccgcggattcctaacttctccaaaacagacccttccgtggttcccgctgtcattgaaattgcaaacaaaaccaacttacagcctgcgaatacatttatagagaaaaactggaacgacagcgctaaataagcaagaagtttacatcatcatacaatgaacaaaaaataccaagggactcaaacccttggtatttttaatgcgttcaatcgggccatttattgaatagaactgccccagaagtcgcttcccattacgtaaagaaagcgactttttagatttgattttcaagttccttttacaaattttgaaaaggccattgactattcagttgtactgtattaagtttaactatatagtcgaactgaatagaggatgaggatatgaaacataaattattaccgctgtctgaaaccatgcattatattttattagctctccgtgagccgcttcatggctatgccgccatgcagaagatcgaaaagatgagtaacggaactgttattttagcagccggcacattatacggcgcgattgaaaatttgaataagcatggctggattgagcctgttggagaatcaggccggagaaaagtctataagataactgcggaaggaagcgccattttgaagatggaacaaaacaggttactgcatattttatccctgcacgaaggaagtgaatcgaatgaagaaatttaagatgttttttgatattgaaaaagaggagcaatggctgaacgagcaactacaaaaaggctatcgctgtacaaatatcagcggattaggaatatacactttcgaaaaaaccgacaaaaaatatgtgatgagactggattatcaagattatttatcaaagaaaaaatttaaagagtacaaagagatctatgaagacttcggctggagttatataaatggcccttgggggcttggaactcggtattggcaaaaagaaaatgatgatcaaaatgaaatcttttcggatcgccaatcaaagagtaattattataaaagactaatggggttttcatcttgttttggtttactgtgcttgttttattcttatttgatttacaaggattcaggtttatatttagctgaaggtctgtggagtatggaaggcgcaatgttttggaaggcatttttatttgaaactccatttgcccttttgaggtcgcttcccgcccttatggctgttctatttggctgcagtttctataaaacgtatcgaaagtattcaatgttaaaagaacaataacacggggaagttacattcaaagaagtaattgaggatcatgtatctgccgaagccgggcgctttaacggaaaaaaagcgccctgaatttgctgataaatcagatgacttattttgttaatgatacatacttatttacaatggcttgagcgagacaggctgatgaatcaacaatagtaagtccgcttcttttttggtccgtgaccatatttaaatccgtacatgcaatgataaccgtatcagccttttctgctaagtcatggtgtaattcatcatataatgtaccagcctcatcgatttgaccttgtttaatcttttctattatttgatcgacatagatttgccaactatcttgatgtaaaaaatcataaccttctctgtttaacgcttcttgaaatattccggattgaaccgtaggaacggtggctaaaagagctgctttttttgagcctttaggtattttttttatggtttcatcaatcatgttcagtaaagggactgaaatcgatttctttatttgattaaaatagagatgtgcggtattacatgggatggcaataaaatcaacacccgttttttcaagctttacagcacccttaataattgcattttccatgtccgtatgattgagaggtttattcatgtagaaaggtgtcggacaggaataaatcatcatatgtggaaaatccgtgtcatgtattgctccatatattttttggcactcgtctacgactttatctacaaatggcccagtagattttggccccattcctgccagtattccaatcataattgtcctcctctgtaaaaatgtgtacgaatacgatcacgatgagttattcttgtgtttctcatctgaatctgatctcatttcttttctggctttcttctcctattttatcatttcattaattgaaaaagggctttaaaaaagatagctggcaaaccagacgacttgctttaagtaacggcgcagccgcaaacaaaaaataccaaaaacctcagaacccttggtatcattgtgatgcggctgagaggacttgaacctcaatgggttattcacccgctgggccatcaataaagtgaaactgtgttttctattacaaaacctttatatattagtgtgtgtttatattgatcatgttattttacaaagattaattcatattgtggagtaaaaatggagtcgtttttttcatcaccagaaagttacatgacatgtcttgggtgccatgtttgttaaaatcaccatcttcgttttaaaacgtacaggtttatagtgttccaaaacgctgtcctaaatgcaaaaaaatactggacgcaactaagtcaaatgtttttcacggtactatagtcaagacttgcccaagtcaccattatcaaaaagaattaataagaaaccaacgggtgatgaatcttttaatctttcattttacccgctgactcatatcaaaggagctttaaccaaattttaatagctgtcgcacttattaatagcgctaaaatccattgcaggaattttgtatttgctttttgcccaacagatgcgccaataggagaagcaatcaaactggcaatcataagaaccagagccggtgtaaaaagaacctggcccgtgattacttttccaactgttgcgccaatagatgaaagaaatgtaatcgcaagagatgaagcgactgtgattctaacagggatatttaaaatcgataacataatgggaaccaggataaaggcgccgccagctcctaaaatacctgatacgccgccaatgagaaacgctagggacgaagccaaccatttattaaatatcacttcttcgtcttcgctatgttcttgtccttttttaggtataaacattaaaataactgctagtatagccagaattccgtatataaagttaattcctttttcagatatataatgagaaaagtaactccccaatacactccctaaaaggatgctgcttcccatgtacataattaatgctttatttaaaaaaccacttttacgataagcccaaacacccccaagtgtcgcaaagaaaacttgaatagcccctatccctgaaacttcatgggcagttaatgacatcactcccactaaagaaggaatgtataatagcattggataattaataactgatccgccaatacccatcattccggaaataaaggcaccaataaaccctataatgaaaagagttgtgataaaagcaatatccattttggttcctcctttcaaagaaaaagggcatctttgtattcgataccctttcacattcattagccttttttaatccagaattttaatacatcgccttcatcagtttgctctaaaagatcatgcccgcctgatttagaccaagctgcaagatcatttttagctcccttatctgttgcatgcacttctaatatttgacctgattccagttcattcatcgctttctttgttctgacgattggcattgggcatgccaggccttttgcgtctaatactttatctgatttcatgttcatctctcctctttttaatagaaacttgagttaccgtattgcacagcggtttggaccaatctccatttcacgctgtttttcttcatctgggctgattttccccatgtttgtttctcgaatctcttggtatgcatttggctgcggaggcaaatgatctgttactaagtgtctgaattctgtttcatccgcaatgttcaaaccatggttctcgctaaataatgtacttagttttttaccaacacttccatccttatttagctcgtcaatgatcataaagtgtgccggtaatacaattaaatcctgtgacaacgcgttgtaacggctataaagcgttgttcttaaatctcctgcccaatcttctgccataccggctaagtctggtctgccaattgaatcaataaacaagatatcacctgaaagaagatactgatcatcgacaatgaaagaagtggaaccaatcgtgtgccccggagaataaatcggttgaattttaatctttgtatttccgatggtcatgtcgttcccttcttccaacggctgataatcgaataccgcttcttcagcatctttaggcggtaaccagtaggctgcttttgttttttcagcaatgactctgccgcctgaaatatggtccgcgtgaagatgtgtatcaaatacgtgagtaatcgtcgcactcttctccttcgcaaaatccaaaaagaaatctaccatacgcgtcgcatcaataatcgccgcttcaccattggaaatgaccatgtatgataggcagcctttaccgattcgaacaaactgatacatctcaccgccatcttttaaatccccgacttttaccggctctaaatgttcgctccatgctttcattccgcccttaagataggatacagaatgacctgcttcagaaagcatttcggataccatgacagatgaaccttcttttgcacaaacgaccagcacatctttatcagaaggaattttctccaagatatcttctacgccatctaaaagatcgaaatacggtacatttaaatggtcaaaatcatgtccttcaatcttccaatcgctaaagtcattttcattacgtacatccaaaataaataaaggttctttgtgaaagattttttgtgtgacttcttttgcggtaagtgcttgcacggtcatgtttacatacctcctttttctgttttacctgtccagtcccgcataccgggaataacattaataacctttttaaaaccttgttttttcatggtgtgagctgccatttcacttcttcttcctgaatggcaaataatataaatttcatcatttttgtttaattcgttaaagcgcttttccacttcgccaagagggatatgcaccgctccggggatatgggcttcttcatactcctctatctctcgtacatctaaaatgtgaagagactcatcacgatccactttctgtgtgaaagcttctaatgaaatctcaggaattgaagatgcattttctgatgaatgctctcctccttttcgaagaaagtgacgaaggacttctccctctgtttcagtacctagatattcatggcctgagctttttgcccatgcttgcagatctgccgccgatcctttatctgttgcttgaatttctaataggtcaccagcttttaattcttttattttcttctttgtttttacgataggcattgggcatgacaaacctttagcgtctaatacaatatttgctttcacggtttttttcctccttttcttatataggggcgggggtatataaatatgcaaaaagttattccctggatgttaataccatgtattcataccgccttttatatttgtgatgtttttaaacccttgtttcttcaatattttacttgcctttacacttctcattccgctttgacagatcacaaagacgtctttgtctttcgaaagttgatgagtttgacgaggcaagatagacaaaggaatatttttgaatcctttaatatgccttgtacggaactcataagaagttcgcacatctataaactgtttgtctttgttttccgcctccgattttaaatcagcagttgttatttgtttaacaccatgcaatgggaaaaaacgtcgaaatacgatccaaagtattgaacattactccgctattcatagtgttatatccccccttcacttattcaattgcaatggatcacattagataaataagttgacattgccttcctcagcgtctgccaaataagcagctacaccagcatagtcgatatcatctaatagttctttttcctgtaaaccaagaagatccattgtcatcgtacaagctacgagctttacaccttgttcttgagccatctcaatcaactgaggcaacgtaagtgcattatgttttttcatcacatttttaatcattttagggcccatacctgcaaagttcattttagataaacccatcttatcggcaccgcgaggcatcatcttttcaaacattttttcaagaaatccttttttcactggaatcagctcttctttacgtaaagcgtttaatccccaaaaagtatggaagatcgtcacttcatgatcgtaggcagcagcaccatttgcaataatataggctgccattgctttatcatattccccgctaaataaaacaattgttgtgcgttttgtttgttttgtcatgtttattctcctgaccaatcactattacccctgggggtatattggaattaaaaattttttcgaaagatctcctattattcaattcaatatataaaataccggtaggggtatattataataaatataaaaattcgtcaaccttaaagatgataggttgatgaatttttttatcggctctttaccaataagtcgaccgcttcttttactaagtgttgtgtgtcttctcccttttctaaactttcacgaacacaatgttcaaggtttgtgctcacaatcaaacccattgctcgatcgatcgcattacgtgaagcagctaattgggtcacaacctctctgcaatcttttccttgttccatcatggtcaatacaccttttatctgtccttctatccggcgtaagcgatttttaatcttttgatcatattccatgcgttgaactccttctttgaaatttatatatttgcatgttatccactatcatttcatactacgctttatcacactacattattaactagataatgtttgtgaatcaatattatacccttacaggtatactgtcaattttcaagacggcatgagaatgattttaaagagttaatattagtatcccctgtttaatcacaagaaggcgctgaagttgtacgtgatttaatgcgtatgaagaaagagaaagcacttaattcaagcgaaaaaaatgttggataatgcatatgaatttttgattagtgaactggaagtcattaaaggaatcactgaaaaacaaataaaaagtttctgttaaggttaatgacagataagtttttcagagtattacgatcagacgttcaacttcttcaacttactttttaaacattaaccgcttttattactcctcaatctaatctgttatatttttttcttcaacgaacacttgaattctcgatgaaatagtcacttgatttttgtaatcctgattcaccctggcacggacaaggagccgtaacgatggaagagaggcagggctttcattgttttaggtctaagtgattatttccggaagaaaaaacaaccactctcccctttatctttcagaatttcttacatctcttgcgacagtgaatagcagttttttatcttatttcataaaaaagatatgcgaattgtaacaaagaataacataccgttaccttgagaacataaaaacaaatcatctatatatattccacatatcgtcaatccggtatgttatactgtaaacaatcctttgaggttttaaacctttttcttaccttgtagcatctgtccctactcgaacgttgagtagggtcttttattcagtatgatacagagaacataaaaaaacaggccctatataaagagcctgtttgtataaacgattgaagattaagcagttttttgaacgttagcagcttgagctccacgagcaccttgctcaacgtcaaacgttactttttgaccttcgtctaaagatttgaatccgtcactttggattgcagaaaagtgtacgaatacatcgtctccattttcacgttcgataaatccaaaacctttttctgcattaaaccatttaactgtaccttgttccatttttgttgcctcctagtgtattacacattgtattactatccttgcccaaagtatcatcaagacgaaaagtcgatattcatactatcctttacacgaacaaaaataattctcctttatcatagcacgaaacggaaataactgcaaattaatatcatgtttcattcagggttttatttgttaaacgtgcggcaggtttttttgcgagaacctttatttggaaattagaagttttgacggaccccttaccgtacttaataataaatatcatgttgataggtgtatttttaaaaagcccactcacgaaaacgagtgggtttacaaaagctctaactaacccgcaaaggttttagtcagagctatttattttttgatccaactcactaagcccctactctgtcatcagctcgataatattcattggaacgtgataaatcccctttttcataaaaataatcagctactctgattgcaaagtttttcaatgtctccgtacattcttaggaggaagataccattagcgatgacgctaatggcgccctttgtttctactcagtaacttattcagcttctcccacaactgtaaagcgttcatttatatgttttggattttctatttcatccaatactgcaattgcatagtcggcatagctgatataactttcgcctttcgaattcacaagaagatgatcttttcctgactgataaaacccagttcttttcccgtctgggtcaaataccgctgaaggactgataaatgtccagttcatatcagaagtttcctttagttcttgcaagttacgaccttgccctttagctgttggaataaaaatctccgggaaatcaggtgtatccattacactgacagttttattttcgtctacataaagactccctgctccgcctacaattactgctcttgtacccattccttttaatgccctaattaatgcccggccagcatctacatgtgcctgttcttctcctaatggagctccgaaggcattaactattacatctaacttttttagatcatccgatgtaagatcaattatatttttttcaatgattgaaaccttttcctctttaagttttgcagcatctcttacaattgcagttacctcatggcccctgcttaccgcttctttcaagataagacttccagcttttccggttgcaccaatgattccaattttcaatttaaagtcctcctaatcattcaaaattttaaatgtaaccaaattgattacatgtaataattttagttacaccttatttgtttgtcaatacttttatcaccttgttaattgagcatattagagtgaaataaacttgtaatacattcagttacaagtgtactataaagagtgtaaagtaattaggatggtgaagaaatcatgtctattagcagccgttttgctgtaggaattcatatattggctcttattgaaataaatgaagacggaattagcacttctgaatttttagctggaagtgtaaatacaaatcccgccttaataagaaaaattatggggatgctgaaaaaagcaggtttagtaaatgtacggccaggtattgcaggagctgaattagcgaaggatttaactgaaatcaccttacttgatgtttatagagcagttaatgttgttcaagataaagaattgtttagtatacatgaaaatcccaatcctcaatgtcctgtaggccggaacattcaaagtacaattggtccaatatttgaaatcgcccaatctgccttggaaaaagctcttggacatataacaattgaggatgtggtgaaggatattatcgaaaaagaaaaatcggccgataattgttaaatgattcacagaaaatcttttatcagactggcgataagaaaaatcaataaaacaaaaagggactggatcatattgaatccagccccgaattgatattgattttagatttagattacggtaagggatataaatatgctcatgataaagagaaaaaattaacgacaatgcacacgatgccagattctttaatagggcgtgagtattactatccaacaactcaaggttcagaagctaagttcaaacaaagacttgaggaaatctcggattggtataaaagaaaccgcaaatcttagtttgaacgaatatgttctgtatataaaaataatgaggtatggagtgaattgataatgaattatgatgaaataaaagattactgcctaacctttccaaactcttatgaagaccacccttttggagatggttggactgcaattcggcacaaagggaataagaaaatatttgcacttatcttcactcgcgacgaacacttatgtgtcaaccttaaatgcgaacctgaaaaggctgattttctgcgtggtctttttgaagaaatcaagcccggataccatatgaacaaggagcattggaatacgcttaccttagatgagggactcccagagcatcaaatccatgacatggtaaagtacagctttgaactgacaaaaccaaaaagtaaaaaggaaacataacatcgaaggatagaacgctcattatagatattcatccggtgcaatgatacagaggaatatgcaaaaaacctcaaggcagcaatttttaaattcgtatttacgagatgattttttcgttattgtgagtcctttgtttctcgacataggttgaacaaataaaaaaagagcagactcaaagtccactcaattaattaagatgattgctcatttcatccagacacctataaaatatgaaaggtgacgatgatatgccgcaaaggtcatttagcgtttaattaatactgataactcaccttcaaacactttttcctctttctgattataggtagataacaatacagtaagtatccccgtctggcttttatttggttttttatcaataaccttaacaatagtgttcagtttatcattagggtaaacgggtgctaggaattttatattattcattcctgtcccagcaataatatcgtcttcatgacacccttcttcaatccaaagcttaaaagtaatagataacgtttgtattccagaagcaataattccattaaacctgcccatttttgctttttcttcatttaaatgcatgtactgtggatcatacacttctgcaaaattcattatattctcttttgttaattcaaaagatttagtttgaaaaacctgcccgatggtaaattcatccaacttcataaataaatctccttgaatctaaactttattattaaatctacgtagcattttaacatactggctctcacacaacaacttaacggtaaaacaattgttcccctatcaggaatgaacaagcacattgtttttgtttccttgcctttaacctctttataatcaggtgttttcttataaagaccaaggcggtcgccatcaccatcacccggcatatgtgccatttcctcataagaatctccaagcttctcataataagaataagcagtcagcctacgagaactttcttctggctgataaaacgcaagctgaatatacttgccgtcatcatatacacgaattatggcgttatctcttttgtactcatctgaatctgctcgcatttcttttctgactttcttctcctgcttcatcacttcattaattgcattatcctatttactaccgccgcacgcagtcagcagaaggatgaaggtgactgacaaatcatacgacctactatagtaagtctataaacaaaaaataccaaaggtgtcaaaacccttggtatcatagggatcggccgagaggacttgaacctccgcaggttattcacccgcttggcccacgatctatattcataaaactattgctcagttgtcagcatgtgaagtaaattacgaatttccttgttataacttttaatttcttcttcattacaaccggttttatcaaatactgcattagggatcattgtgactttttctttaaactcattcccttcagttgttaacgtaataattacacttcgttcatcctcttttgaacgctctcttataataagacctcgctcctcaagtcgttttaaaactggagttaatgttccggagtccagatataattcttcgcctaaacctttaacagatattttttccttctcccataaaacaagaagaaccaaatactgtggatacgtaattcctaattcttttaagagaggatggtataactttatcatttcacgggaagctgcataaatcgcaaaacatagatgattacttaacagtaatttatcattcttcatgttaaatccctcacaatatttatattcattactacacataatagcataagaattacattaagtaaaattgaatgactgacaatttaattaaccataacttatatacatgggaactttatttataaccaaaatgtgtttgaggtgcattcttattatgaccgatatagatacttctactatattgtttagaccgactcatagatttattgagccaccttctcaatatggttattctgtacactaactttaaactgccgaaaactgttctttattttagtctaatcattcatttagagaattttaattgagagcaatttaatttcaaaaaatttaattgacaacgctgattagattgattaaaattcaattgtgttaaatttaatttataggagtgtttgatgatgacagtatattttacagcagaagctacaacaaaaggcggaagagaaggtcatgtaacatctaatgatcttattattgatttggatttagctatgccaaaaccaaatcaagtatccacggctacaaatccagaacaattatttgcggcaggctattcagcttgttatgacagtgctcttcatttagcagcccagagacaacgattaaaaatcgaatcagctgttaccggtaaagtaagtttattaaaagatgaaagtgataatggttataaaatcggagttgttctggaggtggaaattcaaggggtatctcaagagcaagcggaagaattaacacatgcagctcatcaagtatgtccatattctaaagctactcgcggaaatattgatgtacaaatcattacaacagcaatgtaagacgaaagatgtcaagatcaataggtaatagaataaaaaaatttgattaaaacatataggtgaccagccttcaaataaggagtgagattgatgttaaagaaagtacaattagaaaaagcagctcaagaatttgcagaagcaaccgcgaacccaccctatctattcgaccttggacctgagaaaggacgagaagctgtagatgaggttcaatctgacccaattgataaactgccagttgatattgaagatgttatgatttcaggaggaccgagcggacaggtatcagtaagaataatgcgcccgcagaatgcgcctgcgcaccttcctgtcatcgtgtacattcatggggccggctgggtatttggtaatgagcatacacatgatcggctcatccgtgagctagcagtcggagcacaagctgctattgtctttccaaattacaccttatctccagaagcaaaatatccgacagccattgaagaaatctatgcagtagtgaagtgggcatctgaaaatggccgtgagaacggcatgattcctgagagtctaacaattgcaggtgatagtgttggaggcaatatggctgctgctgtcacgctaatggccaaagcacgaggtgacttgaatatccggcaacaattacttttctatccggtaacagacgcttctttcgatacggaatcctatcaccagtttgctgcaggatactttttacgcaaggacgcgatgatgtggttttgggatcagtacacaaccaattcgaacgagcgtgctgaaattacagcatcacctctgcgtgcaactgatgagcagcttcaagggcttccacctgcattgattatcacagctgaagctgatgtacttcgtgacgagggagaagcatatgccaataaacttcgtgaagctggtgttccggtcactgccgtacgtttccaaggtatcattcacgatttcgtgatgctcaacgccttagctaaaactgaagctgctcgcggagcaattgatctcgccgcaacctggctgcgtaaagggttttaatccatttattgtttcgtcacatagagactgctgcaaataaataaaaaacaaacagatccactcaaataattgagtggatcgtatattggaataatggaacttttgatgagctttttaatcgggctggttattattttgttgttgagatgtccctaattgcaaagctaactccacaacaaactccgttttttcaccagttcaccctcttcatatccaaaaaacctttgttgattagttagcgtacaagttctcgttttctgctttggaccccatacagaaaataaaaagccagctctccttcgtgagaagaaccggcataacaaagcttcttgcttcttattttgctgtattgcccggaccttttaatttctcttcgttcttgcgtcaatgttttattattaggacacaaccaataaaataatgacgatcgagaatagcaacgctgcatttgcaaagcagtaagccctccagagtataaaagagctgcagtcattgctgctcggataatcccagcttattctgagtctgtatttcgagtagtcggtcaattaaatggatgtttttttcattccttttctgtttgttccattttccaccacagtgaatcttttggattttcaacagcttcttgaaactcggctttagaagcaactgttgggtaagaaccttttaaagatttacctgaagtatctttaaataaggttaacacaactattaagccaattaaactgactgccaataaatagaaacccggcgccaaattgtttcttgtcacatgggttaaccaagaagcaactaaaggtgttgttccgccaaaaatagaaactgataagttgaatgtccaggataatgtacgatatctaatgtccgtatggaacaacgtaggtaaagatcctggcatagtaccttcgtatacagataatacaatacctaacattaaaagtcctataaataagaatgttatattccccatattaagaaattgaaaagagataatcgaaaatacaattcctaatactaatccaattgttataacttttttatttcctaatttatctcccagtttaccaaaagttaaagcgaacggtaccataataatcaatacaattgctgtaaccggtgtacttatattatcacttataccaaggttctcatctaaataagaaggcatataccctaataataggtaattggttatattgaaaaatgccacaaatacgatacataaaaagatatcttttttatatgttctaatgacttctaataaacctggttgttgttcttggttttcagagatgtcactttcaaagattggtgattcatctagatgacttctcaaatataaaccaaataatcctattggaatacttaagaagaaaggaattctccatccccaactattcatttgaacatcagataaagtccagaaaagtactgtaactaaaacagaagctactatataaccagataatgtgccgatttctaaaccgctgcctaaccttatacgtttattatctggagaagattctgcgatatataccattgccccagcgtactctccacccacagaaaagccttgcagaatacgggcaaagagtaataatataggggcccataccccaatctgatcataggtaggaagcacaccaattattaaagtagataaagccatcattaaaatagtaattgttaatactattttccgaccaaatttatcacccattttaccaaaaataattccgcctaccggtctaagtaagaaggcaattgcaaatgtagcaaaagtaaatattaactttaattcatcgttttgaactggactgaaaaagtttttactaataataactgccaaataagaatataaagcaaaatcaaaccattccatcgcgtttcctatccctgtagcaaacacgcttttcttcgctttttgaatgtctacaacgttaatttttttcttgttaaacttcatttaataatatcgactccttaattatcaaatccacattatacaagcgtgtaaacggtccgagcatgcagtcccagaatgtatagcgtaatgcttctctaaaagtccgggggtttctgtttcacctgatggagagctaacggcatagtggctgattggttcaactgtaccttaaaagactagactaatatccatatcagcgccaaataacattgtaaaccaggaaagaaggatgaaattaagtgttttcgctggtttccttaacttatttttgccgattgggctaaaaataatacaagaagcaacaaaaagagaaacagccaacagataataccagccaaagcggttagtgagatatccttgggctgtggtcggtattttctgcagacgatttggagaaatgattccccttcatacagctctattgtgaatatgatcacaatcgaaaaaaaacttttatttcttcaaagtatcctaaacctttattttagatcttccattacgtcttccaatatgtttattataagattgaggtcgttcctaagaattatttactgattctatctttattaccccacaatcaggtgaaacaaaacactataaacgtagcatacctttttaaaacctgacaagcccaacggggtgatagaaaccaggctaaagccaagctagtcaatggatagaagaaatttttttgttttcccaaggaataaccgtctgcgtttaatctagcccaattagaaagaaaaagagcaggagtaatcctgctctttcattcaaaactttaatttgtatgacgaatttcgtataccttttcaactttctttaccttagactacaacagaaataagtagcacagggtatgaaataatggttttatttttgatcaatcattaaatgatcctcaatgacaataaagataataattactaaaatttcaggaaatcccaatattgcttatcttaattattgtttaactaattggtaattgcaacagtaaacttatagttatggaaagttataccagccgaaaattttccgactcaagtctgtttaaccagttgtgaaccaatgaattaaatacatcggtttgttcgatttgcaggttgtgaccagccatatcaagtactgcaaaagttgcccttgggtaatcttcgagtagccgccacgcatcatggtatccgactacattgtcctgacgccctgtgataattagcgtgggatactcaagtttagatgaaatatcgaaggtaaacccatatccattttgacgaatgttgtttacgaattcataatttgtttgtttagatggaagtaaaatttcatcccgaaacctatcccattcagttttaccttgcacaatccccatagagcaaaattcatccgcctcctctgaagacaaatgtgatatcaagtcgctgtctctttttagaacagtcttctgcggtactaccctttcatcgaattcgggtatagttaatggtgccatcagcagtaatccacgaactgtttccttacgtgaacgaacgatacctctggcaatgtaccctccatatgaattaccgcaaacaataaactgttgatcaggaataatctcgtccaaaagacgcaatatcgcttctaaaacatcatcagagttctgaatagacggttgtggcttagaatgtcccatacccggtaagtctatgtatattctcttccaaccgcttcgtttctcgaataacggttccattgcatttaacatcacctgatggtcaagtgtccaaccatgcaacataacgatcggatatccatctccaattactttatggtaaatcgacatgtatttgtttccccttccctgtaatcctaatgtttcggcatgaacatttagtcctttcatacatttatcacaattttaacaaacttttaactgaacttggtaagttgaacaagggttatacattgaattttgacaatcggaactgtcatatgtgtccgtcatatcaaaagtatctgtttaatgtgttgtttagtgctttcgttactgcgactactgacaaataagaaccaagcaaagtattgtccagatacgttgagtattttgatcactttgcaaataagttattgaaaatacactacctaaaatcactgcagccaatagacaccggctgattttcaccacgggttattcacccactaggccctcaacattgtgaatccgtatcactgattatgaaagcttattttcattacactttctaacatcgccttacatcatttctataggtttgaatgaataatggttaataattggtgagtaaaaacccccttaattacccacttctagaaatctcattacgttcaattcattacctcttattcaacaattttttcgaacttcacatcctgtccatggtaatatttagatataaacttactgaaaggattgtccaatgaaagtatttgaagcaaggtctttgttatctgaagctgaaaaccgagcaaacgattataaagagttgaaaaatcaaatgattaatttgaaaaaagcatttaaggctgttgctgatcttgatgatagtgagttctctgggaagggagcaaacaatattaaagcattttttcacgatcacaccggtgtagctgatcaatggattgatttcattgatatgaaaatcgctttccttactagtatctccggtattctggaagatgccagcttatctgatgcatatatcgaagaatctttcttagaacacgaactggcaaacgcatatagaaaatcacaagcaatgatgtccgagcagaagaaagcaatgaaagatatactgagtgatattgatgacattcttccacttgatttattttcaacagaggcttttaaggatgagctctcgtccgccgaaaacaaacgaaaaaaaattattgagaaaataggcgatacagacgagaacttaaaaactgaatatgcaatgactgaacctaacgaacaatttattaaagcagactttcaaaagttacaggaatcaacaggtaagggcaaaaacgcttcacccatacattataatgccaaggcttatcgcgagagtgacatacataagaaaaaaagcgatatcgaaaagaaatctaaagcttatttaaaaaccaaaaaagaggaagctaaaaaacgcgaaattaaagatttgaaaaaacagcttgtaaatgtaacagatcctgacgagtatttaaaaattgctaaaaaaattggatacgagaatttggagcctgaccaaaaagtttatttccgccagctcaaagaacttcaacaaaaagccgatatcggaaaaggtattgcagttggaatgtatgaagccggtaaagataccgtgatgggtctctatcaacttgcaatgcaccctattgaaacgctttctggaacggtgaacgcagtcttacatccaatcgatacttataagatcatagcaaaagacatagaagacactttccaacgtgatatgattaatggagatagctacagcagggcaaaatgggtgtcctatgtcggcagcactgttgttcttgcaatagttggtccaaagggtattgataaagtatccaaagttgccaaagccggttcaaaagttgctgcaattaagacgctcgaagtttcaaaagcaggaataaaaaaaggtattgaatacgttaaaataccaaatgtttttgaacaacagtatgcaatggctggtggttcagggacttttccattcaacacaattgacggggagagttataaaaactctgcacttgaagtttttaagaaccagtctgctacacatggtataaaaaaagcaaagccgcatgaagttgtaaacgaattagagacttttcaaagcaggaaatacatttttggaggacaatcatttctcattgataaacgtggaataaagcatattttagagcgccatcatcctagtttatgggatggttcagttaagtctcgtcaatcttttctcaataaagagatggctgttagcgatgttgcagatgcgatagaatcaatcatgaaacaaaaccgtgaagagttagtacaaaaaggaacaaaattcagttatcaaattagaggaacgtataagggtcagcaatatgttgtaggctttcaaaaaggaagagtaggtcaattctatccggaaaaataggagaggtaagaatgttttatatacaatcattaattctcaagccaaataagaagataaaagatctttcagtcttaaaaaataatgttgacgattactttgtcccacttaacaatataggggaacttaagaacatgaaatcacagttagatccctactatttatctggggcgattattttaaaatatggtgaacaagatttgcttgatgtcaccatgtgggacttggttgatcaattgtgggcttattttttgaatttaagtgaagaaacaatcgaaaaaggagaaggcgaaactttttttccagatcaaccccttctgttgaaaatgaaattaatatcgaatgatatgctgttatttgaaattgaccaaaaacaaaaagtaatactgccgaaacttgatttttttgaaatactcttaaaaaatgcaaaagatttctttgaaactatgatttctgttttagaagaaaactgtgattatgactacgaactcaataagatcgatgaattgcaaaccaaaattaaatgtgtgtgaggctaaatgtgaattaatctggagtgaaaaaattcgttgttgagaataaaaaatattcaattcttactggaggcgtcactgacaaacaaatctttttcatagtgagcatccacgcattttcttattttatctatcaaaacaaaaaatatctcttgaaaaatccctttagggcattgttcagctgccttttcttacggttatttattctctcacaaatagcacaagatagtggataaaaagatgaagagtagcaacttgtctactcttctttttaaatgggaaatatttaagatagaggttgggttctccgccccactcaccaatataaattacatccaaatagcttgcccaacaacactttttatccgacctaaccagtggtctccaattctctctaattctagtatttgatcatcattcgcgtcagctaaatccccaactgttttgaagttactactctctaaaatttctattcttctagaagtcaagccatacggatatgcatttgattttttaagcacagagattggtttttctaaaatccctagagacccatttccttttaattcaggaagaattatattatctaatacacctcgtttatatatttgaggatattccttttctatactattccatttcttgaacaaatccgtcgtgagtctattccccgggataacttccaacaaacttgataaattcaaaatatatctagttcctcttccaccacttttcattgctctggatgaatctcgttttacaataaaaccagcatactccattatttcgaaaagtttttttagccgttcaattacatctcgatgaattaaacaagaaggaccataccctggcctgtccacaaagtaactaacttctttatatagcgtctctgtaagctctctagtaggccttattaagggttcatattttccaagcttcggttctaattcttcaagtaagggccagtagtattctgttgctaaatgttttaatgttgcttcaatttcacggagtccaattacttcatgttcttccgatatttcaataatgtgattaattgcataaataaatgctcttacattacccgtaactgctctaccaacaaatcccgaaaaatcctcaatagaaacttttaagaactcttgaagcgaggaatttgaataccgcctttctaatatttccttaaagaatgacgtaaaagacgggttttcctcatttcgtgaaatatctattactgttgcatcattaagcaaatcaaatctagaaccgaactctgtaacacctggataaatagtcgctttacatgaaatagtattgcttgataaagttctgaagatatcaaaaaattcttttaaagatgtttctctacctatatgtgcagcatcatcaaaaaacagtattatacgtttttcaattttctcagatagattcgtaagttcactttgaatagtcccgatttctgaagcaggactgaaatcatcaacaggaatatctatatacttgtcaatagcaattcttattttatctattagtaacttacaaaatatatcttcataatctttcccttctgccctaagtaagggcaggtgcctaacgctcacataaactcccagaacattttcagagagatctccttcattcgatctaaaataagcttcttttaataatgcactttttccacttcctcgccctccccttataagtaccggtccatgagctattaattttcttataattttattttcatacttagaaaaagtatgatatttacgaaactcttcatctggaaaatcttctgctgccaatattaatttgctatcaaataaatcactcataatgattctccacccaatcatataatttttgatagattacaaaagcgttatcataaggcaaacgacaaatacaagagtctatataatgactaacaagtccaataatagaacaaaatttcacagcatctaataataattcgactacagttgatttatcatatattatttctggtttaatcaaaaattcactatgtacccccttggaaagggatgaataaattttagacgagcgtgttcttaaatactctgtgaatttatctgggtcaactgaacttcggtaataatttaatgattcatcatcttgaatggtctcatcatcaatcaacatctgataagcaggattccaaaatgtatcaccatatgcatctccaaagaggcctcgccctaccttttgaaattctttatctgggttccatatagcaccgtttgattttttttcaaaaacatcaccattccaatttatcgctccacttgatttcttaccaatactatagctatctaaagattgaattttgtgcacgtaaatcaatctaaaaggatcaaatcttcctattaaagctgaacatgaagattccaatatgtttcttgcataaaaagggcctaataaggtcaaatcatcactatcattagttagtaaaacattaattcttgtttccatgttttttatattattaaagagtacatcatacagactttcaattgatttatgttgagcatagtcaccacaaatcaatcttgctagatcatccataatttcataaatcctccatgttattttagatcaattctaccacaattgaggttaaatgaggatgaccttcatttctaatttatctcttcttgtttctaatcgtctattacaaaataaccgaattccaaaggaagcttactatgtggttaatgataaaattttctacagagttgcaatttcaacataaaaaaataataccaaaggtagttaaacccttggtatcattgagatgcggccgagaggacttgaacctccacgggttattcacccactaggccctcaacctagcgcgtctgccattccgccacgaccgcgtgctatgaagctgtctttccactaagcatataagctagtgatgatgatcagcactttgaaaagaaagtgcgggtgaagggactcgaacccccacgtcgtaagacactagatcctaagtctagcgcgtctgccaattccgccacacccgcgtgacaagtggtgagccatgaaggactcg

SEQ ID NO: 120 - DNA, 88349 bp, Bacillus velezensis FL50S
agcgcatgcagcggattgcggaaaacactgtggcacatacgatccgtaccggctctgacattcaggtcggcttttccgcgattgatccggcaacagggcgcgtgcttgcgcttctcggcggacgtgactacgaaaaaagcccgtttgaccgggcgacacaggcgaaacggcagccggcttccacgatcaagccgcttttgtattacaaagcgattcaaagcggctttacaccggtcacgctgatgaaaagcgaagccacagagttccagattgacgacaacggagatacctattctccaagcaattacaacggctactacgccaataaaccgattacgctgcttcaggcgcttgcgttatcagacaacatttatgccgtgaagacccatctctttctcggcatgaataagctcgtgtcggcggcaaaggaattcggcatcagcgaacatttaaagccccttccgtctctggcgctcggaactgaacccgtgcgcccgattgagatggttaatgcctatgcgatgctcgcaaacgggggaaaacaaatcaccccttcctttatcacaaaagtgacggataccgccggcaaggtcttgtatgaacagccgcgcggacatcagcagacgcttgataaaaaagccgcttttgtgacggcgagcatgatgacgggcatgtttgatgaggatttaaacggctatacttccgtcacgggacgcaccatttcagaccggctgacccggacgtacggcgggaaatcaggcacgaccagcgcagacagctggatgatcggctttaatccggctcttgccgccggtgtgtggacaggctatgacaaaagcagcacgattgattcagtagaagaaaaaagctatgcgaagacgatttgggcggactttatggagaaggcgctcgaaggagaaccggaaatagcgcttaaaccgccgaagggcgtcacgggcgtctatattgaccccgcttccggctacacttcgggacccggatgcgccgcaaagcattacacgtatttcatcgcaggcactgagcccgcggatgtgtgctacggaccggaaccgtctaaaaaagaaaaggaacacgtccccgcccgtaaagaagctccgcgcaaaaagtggtgggataagtggctcggcaaaaaagactgagcccggtgcattgcgcgccgggcttaatccgcgtcttcctcaagcacccatgggagcaagagtgaaaagtcgagatggataatagggtcaggaaaacccttcggtataaaaaatgttgtactaggcaaagaaaacgaaaagcggatatctccctctctctcaatatgaaacttcggccagccttccctaagcctgccgacaatcggatagctgcccgcataatgatgcaggccgttttcctttccatgctcccccaagtcgtgacagacagccggacgaatcccaaactgcgtaaacaatcttgttttctcggcgggaaggagattcaccgcctcggaaaagttccggcagctcccgcaatcgcagggatcaggccatgatttttcatattgttttctcgtttccgccgtatctgcttcaatgatccaaggcccgatgtcaaagacggtgaacatgatgaaacctccgcgtaaacatgaaaaaccccgagtcttggttcggctcgggactttccatgtcctgattctgtatcaacagtttactcagtacaattgcaaattagtgcaaatatttataaagttcacaaaaagttcacaaattatttttcgcccggaagcagacccgttttcaattcatcggatgaacgttcccagagcccttggtcatgcttctgcagaaattcagcaagcacctgctttgagctggcgtccattttgtccacgataatgcggcgcttcattgatttatccattaaattcacatgctccggcaatgacttatagcctctgcggatacttctgtccacggtcatttcacaagccgtcacacccgcgtaataagggccttcttcttttctgtcgatggtgacccacacgagccagtacggttttccgttcggcacttcatctttgttcggcaggaatttgatgcctttttcaacgacactgcgggcatgcattgcgccgatgtcaacgaaggcttccttctcttccacatcgacaaataccggagaaatattgtcaaggctcagcgacccggcgccaaaaccgccatgtccgtcggtcggatcacttttaataatattaaatccgattgttttcttctttttttcttccatgaaaataccctcctacaaaagcggttgaaatataatggcaaataccttgagaatccagtctctcccctcgcttaacagcggccacacgacataggagccgaccggtgtcacaaacagcacgagaaacacgataatcccgtagctctcaaactgagtcattttggcgcgcacccgcggcggcacgagatcctcaataatccggtagccgtcaagcggaggaagcggcagcaggttgaataaacacagcgcgagattcagctgaatccaaatagagaaaaagcggtcaagccccatgctgaatgcagaaagcagctccattccgtaagcatgcatcaacactagcaaaaagaaaccgataaaggcaagaagcaggttgcttacgggcccggcgacggaaaccagcactcccgccagccgcggtcttttaaaggcgcggcggttcaccggcaccggacgggcccagccgaaacccgcgaccaaaattagaatcgttccgaaaacatcaagatgtttaatcggattgagcgttaatctgccctgtctcgccgcggtatcgtctccgaaccgatacgcgacatacgcgtgcgccagttcatgcatcgtaaatgccacgatcagcgtaatcacgacatagggcataagctccagcggataatataaaaatctctccaaatgtcaaaatccccttttttaaaaaatgcaagattgtccttcattcagtatactataagtgatctctcttccaaagagaggaaacgataaaggaggatcagcaccatgccgctcgtaaccgttaaaatgcttgaaggccgcacagatgaacaaaaacggaatctggttgaaaaagtgacagaagccgtaaaagaaacgacaggcgcagccgaagaaaagatcattgtcatgattgaagaaatgagaaaggatcattacgccgtcgccggcaaacggatcagcgatacggagtaatccttgataatggccggcgctgctatgtcaggccggcttatttcacaaccttttcaaccaggctgaaaaagattttcttttcttcctctgtcaatgcttcgaacagttcgtcaatgagcagctgccggttttcaatcatttgcatggccgccatttttcccgattcggaaagcgtcatccataccgtgcggcggtcttcattgtttctcgacctttccacgaatccttctttttctaaatgattgagagcggttgtcgtggcggaaggcgataatgtgacctcctgcaatatatctttaatcgtgcacgtgccgtgccggtaaataatcctcagaataaatcctctgatattgtttatactcttcggaattgtcgcctcatcaagctttttcgtgctctttaaatatttcgtgagcgcgtaatccagtacatttgcttgcaagttatcgtgcttcatgcagaaactccccatttcaagatgcatccatcatcatttgtttgttttttattacattttactgataccttacggagaaagtcaaaattccggccggaatgcccgcaacttttatcctgccctgcacagacttttgtctccctcttttttaccatatccttttatgcaatgctggttttatagacacgattcaggtaaaatcattaagggtgactgcgtttgacggtaaggataatctgatcggatgcggcagacaatatgattggaaaagaaaagaaacggaacagacggggaaacagaacacaggattgtcgattacacagaagatgtgacacgggtaaaagccaaagagtccctcttggcttttgcttttggatggagggatgcgtgttgcggaatatcctacaaaaaaaagacatcacccagctgcttgaacaaagcagaaaaaggcagactgccaaaacgatgggtggatttgatttaacattactgggcatcggcgccgtcatcgggacgggcgtcatggttcttacaggcattacagccgcgaaaaacgccgggccttccgtaatcttttcttttatcattgcagccgttgtctgcagccttgcagcattatgttacgccgaaatcgcttctgttctcccggtttacggaagcgcctatatttactcttataccaccatgggagaaattgtcggccatttaatgggctggacgctcttatccgtttatatggtgacggcgtcagcggtggcaagcggctggtcaagttattttaataatctgttagccgaaatcggcatgcctttgccggacagtctgctgcacgtgccgagccagggggggatcgtcaaccttcctgccatcatcattactctattaattgccgtcgttctgtcacgcggctctaaagagagcaaaacctttaataatataatggttctcgtaaaaatcggaattgttttgctgtttatcatcacaggaagcttttttgtaaagccgggcaattggcatccttttatgccttttggaattaaaggcgtcattacgggggcttctgccgtcttttttgcgtttctcgggtttgacgcgatttcggcttcggctgaagaagtcaaaaaaccgcagcgcaacctgccgatcggtattatcggttcactggtgatctgtacattggtatacgtcatcgtctgtctcgtcatgacgggtatggttccgtattcacagcttaatgtgccggaagccatgtcttatgtgctgcagactgtcggacaaaacgcggtggcgggcattatcgctgccggtgcggtgatcggactgatggccgtcgttcttgctcatacctatgcggcgacccgtatatcttttgcgatggcaagagacggaatgctgccgaaagtctttaccattgtcggaaagaaatcgggagcgccgatctttaatacgtggctgatcggactgatcagcgcatgcatcgcgggttttgttgatctgaaagagctgtcggatctctcaaacatcggcgcgctattgacatttgccatggtcagtctgtccgtactgattctgcgccgcacccataaggatctgccacggggatttaaagtgccttttgtacccgtactgccgattttggccattatctgctgtttgtttttaatggtcaatctgccgctgaaaacgtggctttattttgccgtctggctgatcatcggcgtcatcgtttactttttatattcgtacaagcacagcaaattgagacaataaacaaaaccaggcccgcttcatcgcggcctggttttttcataaaaaaagacgaaagccatcgcctttaacaaatgtgtttcagctcttctatgtagtgaagcgcctcatcatattcttcatccgtatatttctgtttgctttttatcgtaaacactttctctttcttttcctcagcttcaaggccgtcaaaatacaaaatcgtagacaccagctccagaaaccgggatgagcggctgttgacgctgtcgatgtacttcttcatatccggcatcttaagctccgcatgatgtaaaaactcggctcccgtctccgtcagcgagtaccggtattgaaagtagccgccctttttttccttcacctcatccagaaacccaagattgcacagctcttcaattcgaagcgtcagttcttcggaatacgggccgtaaaaatgaaaatcatatttttcgtagaaaggatactgcattttcttcgcgatataaatgattttctgcagctttttccgcccgatgatttctccagaatccgagaacaccttcatcagttttgcatgttctttcaacaaattcccgacatctccttttccttctttaccaaaatccttctatgtcagtcccagcagctgccggatttttaattttgcttcagggttttctgaatcgtcgcaaatgaggtccatcggataatagagcttatggtccgtccggcgtttgcccgaaatggattcgacaatggcggactgcctggacagctctttgatctggccgttctgcgttaacagatgaatcggcagacgctcctcctcttcacccggccggtaaaaatcatacggcagatccgatgaagaatcgaccactaaatagtaattgggatcaattcccgcctctttaaagagagcggtcagttcaaaataagccgacatttcctcattcggattaaattcggcatattgaaacagctggcggttaatgaagcggcggcacaagtcggacagaatcgggtcctcttcttcctcccaagcctggaaataatataaaatgatggcttcatcaagcttcagataatccgcaagcgtcagcttcccttcaaaaatggaataaaaatgaacgggagcatgagtgaatatatacccttcttcatggagctgcttcgcacggtggagaattttcgtcaaaatgacttcagcgcttctcgtcacgggatgaaaatacacctgccagtacatttgatagcggctcataatatagtcttcgacggcgtgcatgccgctttgcttaatgacgatctggtcctctcgcggacgcatgacccttaaaatccgttccatatcaaaatgtccgtagctgacgcccgtatagtatgcgtcccgctgaaggtaatccatcctgtcggcgtcaatctggctcgaaatcaggctgaccacctgtttgtttttgtatgttttggcaatgacttcggcaacatcctgcggaaatcccggtcccgcctttctgagaacctgattcacctcggtgtcgccgagaatgatttccctcgtatagtcttcatgatccagatgaaaaaccttttcaaaggaatgcgaaaacggcccatgtcccaaatcgtgcaaaagcgcggcgctgagacagagttcgcgttcattgtcatcccattcaggacgccctttaaaaacatcatcaaccattcgtctgacaatctcatagacgccgagagaatggttaaaacggctgtgttccgcgccgtgaaacgtcaaatacgtcgtaccgagctgtttgatccggcgcagccgctgaaattcacgagtgccgatcaaatcccagatcagcttgtcccgcacatgaacatagcggtgaacgggatctttaaacactttttcttctgataattttccgtttggatacgccatcgtcattccctcttttttttagccgtgattctattatatcggctctgtaatttgaaaacatccttgaatttgtccggcgttttgttccagttttcaatcattgattttttgaagcaaaaaagcctgacccatcgggcgaggctgtcgtaaaaatgcacatttactttttgatcttctttttcactttctcaatcagctcgtcctcagtcggcgccgacagcgggcggttgtttacgaaagcaaacgatttcttgcgtccgggcccgcaatatgactgacatccgacctccacttttgcatccgggtcagcttctttcaaacgcggcagcaatgtcttaatattggtggcctggcaatcatcacacactcggaattcattagccatgatgtacgcttcccttcattcaatgttcctctatgttaaatcttaatttttaaaaacgaaaaaaatcacatcacgttttattgtacaaggattcatcttatcctgcaaggctctgcgtatctctcattctttcagccaatttgtataaatattttccaatctggacattctaataccatcaagattattgggggttgagaacattgacaaagcaaagacaggacgcctggtcggaggaaaatgacctgctgcttgcggaaaccgtgctccggcacgtccgggaaggaagcacgcagctgaacgcctttgaagaggtaggcgataaattaaacagaacgtcggcagcgtgcggattcagatggaatgccgtcgtgcgccatcaatatgaaaaagcgcttcagcttgcaaaaaaacagcggaaacagcggatgcgcgcgctcggaaacggccagccggccaagaagaaactattataccagccgcctgcaccggatgcggacatcattcaagaaaccgcagccgaagagacggttcaaacggaagcgccaaaagaggatcggcaagccgtcatgtccggcgaacatatgccttatgtcgatgaaagcttcaaggaagagttagctagtttatcacatttgctggcgcctcagcagccgagccacaaggcggagctcacaatggcagacgtcattcaatttctgcagagctatgaaggcagcggaaagcaaacttccgccctgcagatggaaaatgaccgtttaaaacgggaaaaccaagaacttcagtctaaaaccgagcagctggaagcggccgtcgaaaagcttgaaaaagatcaaaaaaccattcaggaagactacgaaaccttggtgaaaattatgaacagagccagaaaactagttttatttgaagacgacgagcatgcgtctccgtcctttaaaatggaccgaaacggcaatttagaaaaaatggccgaataacgcaaaaaacccctttctttgtcatggaaaaaggggtttttgccatttgtcaatgacgcgcatcctgatctatattaatgtaaacattgttcaggaggccttcttcccgcaagggctgcgcatctcggtccccgcccgcacataagcataaagattcaattcctcatcccaaatggttcttgggaattattgatcgattagctactgtgcaatacactgtatagagaatacaattattagatatgatgggaatgatagtaaatgagtagccaattacgaaaaggagcattggaactttgtgtgttgtccctgcttctttatgaagatttatatggttatgaattaatcaaggtcataagtgaaacgttccctgtatcggagggcaccatctaccccatattacgaagacttacgaaaaataactatttaaaaacgtatacagcagcttcagatcaaggcccgtcacgcaaatattacaaagtaacagaagaaggcgccttttatcatcacacattaaaatcggaatggcttgacctgtccgaaaaagtgaacagcatcattaaggagggaaaatgaatgtgtaaagaccaatatttaaaacatctccggcgggaaataaaagatctgccggaatttgagcaaaaagagatactcgccgatatcggcgaaatattccaaatgggcgtcgctgaaggaaaaagcgatgaacaaatcgccggcaatttaggaaaccccaaaacacttgcgcgcgccttaaaagcggatattttcatcagtgatgccgaggagcagaaaacatggcgctcctttttcaaagcattcggcctgatgctgggtatgggcatgttcaacttcatgtttatgctgacaccgtttctttttgcctctgttgcggtgttaagtttgatggcaatcggcctgatgctgatgactggatcattctttctgctcgtaaaagtgccgattgtaacagccatttttaacggatgtatggtcctcggagcgggtatggcggtgtttatggccggatttgatctttcgaaactgatattccgcatctttttgcgctatttcaaatggaatgtcagcattgtaaggagggaaaccattgaatcgaaaaatgtggtatagcattgctctcattttaatcgctgccggcctgatcggaagcatgttctacggttttgacggcttttaccctaaatcataaggaaggtgtgcaagtagcatgagtgaaccagccctgatattaaaagatgtctctaaaaccatcaatcatacccctattgtacagtcaatttctttcgatgtgagaaaaggcgagatattcggccttttagggccgaacggctcaggtaaaaccactattttcagaatgatcgtacagcttattaaaaaaacagaaggagccatttcattcagaggcagaccggacagcgactttgaatattttatgagacatatcggggttatcattgaaggcccggatatgtatccgaatatgaccgctttgcaaaacctaaaatattttactaaactgcgcagcacctcgctgcgaacggatgaccttatgaatacccttgcaaaagtcggactggagcaggctgcccgcaaaaaagtgaaacatttctcattaggcatgaaacagcgcttggggctcgcttattctcttcttcacaatcccgggttattaattctggatgaaccgatgaacggtctcgatcctaaaggtatgaaagaattgcgcatcattctttccgatttagcgaagcaaggggtttccattttattatcaagccatttattgtcagaaatggaggagatttgcgacagggttgcctacattaaaaagggacggattttaggaattgaagacatgaagagcagaaatgaccttggtcagaaaaagctgtttaccgtcacggtcgatcatccggcaagggcgaaagaaatattagagcaggacggtattcttcaagtacagcaaaaagacagccgcatcattgaattggaagcggaggaagataccatcccgtatatcattaaaactttggcagagaaagagattctgatttcccgcgtttctgcaaggactttgtcattggaagagaaatacatgatgattacagatcaggaggacgcggtatgagcatatttcatctgacgcagaacgaattcataaaaataacccgaaaaaaaggcacacttttatctctttttttcctgtttctcatcgttttgctggccggccttattatgaatcatgagttagatgcttcctcggataacaattggaaagaacggcttctcgccgaaaaaaaacaggaagaaattaataaaccggctgaaacggcaggcgtttattattctgctgatgttaagaataaagactattatttggagcataacatcaacccttatgaatggaacggctggaggtttttcggcacggttacttcaaacgggcttgagattttcgtaagcttgactgcgattttaaccgtcagcggggttgtttctaaagagtttgcccttgggacgattaagtttatcgctacaagcccgaaccgaagatggcggattttaacatcgaaatttctggcctctcttctgtttaccggcatggtttacttattttactgtgtgagctgtttgctgatcggcggcgtgttattcggtttttccaatgcttcatatccgctcgtctatactcatttaaatgacagtctgtataccatcagttcaatcaaagcatccgggatcattctgcttttgcgtttcatatcaattataagtattgtcaccattgcgttcactttgtcagtattgtgcaaaagccaggcgctctccctttgcttatccattttactgctgtttgccggcagtatattgggcggaactgatttgcttgcccaatttacatggtataaatttacactctttccgcatttaaacctcgttgcttatgtaaataaaagtgcgggtgatgcgatttcaacgttaaacatcccctattccgtaacggttatagcgatctactttcttatttgtttattgatttctttttccgtctttcaaaagagagacattacagcatagacagagaggcggcggcataatgagcggacggcaggaaatattgacggtccagcaatttgccgctgaccgccccttggtccatcgctaatggattcaaataaccgaagcttccgctgcttcgctgctgaaagcgtagaaattcccgcccttcccgtataaaaagcgcctcatcgaatcggagaaatttcataatggctgtgtattttgcaacggcgtcaatgtgatactttctgcactcggctaacattaaacctgaaaaagcaaagtctgatgttttgtaccattccgtgagaaaaggctgcaattctttcatttgcaaataagagacggcataaagggcatctgcctgctctttctggatgccgcccggtgccatgagcaaatcggcctcacgtttcattgcggtttctaagaaaacgatcagttcttccggggtcaccgccccaaaataagctgctaacaccatgaggatcatagaggaaggctctgatttcagttcctcttgtaaaccgcggaccatttgttcaagtccgttatgaaaaaagatgctttttgcggcattcatcctgcggtatatatgatacgcatacgcgaacaggaccggatggcattcgtgcgttttttctccaaaataacggtctaagaatagaatgacttcttctgtatcctttcttttttcaaagtgatgacatgccgctaaaccgcaaaacaggtgcatgagatcatctgcttccatttcttccggctgcagctgaatgttcttccaaaaacccagcagccattcttctgttttttttatattaaaatgttccttgactatccgcatgttccacactccagattcagaatctcaatcgccggcagaagagccggagcacaatgaatggatggattctcgttatttatatgatgaagagccgcttgacagccataaaaaaatggatcgatacacgattggataaataacatattgcacagctgtttcatttttcggctgccgagacaaaacacaagccatttttgaatggacgccttcaagccgggatgaagcagatgctctccctgatctaaatgaagaagacagtactcgacaaactccagctcgttttcagctgttcttttccatgcgtcatggagcaaaggctgaaatatcgaattcttgtaaaagcgcactttttcatggtcagttgacattcccagctcgttcagcaaaccggcgaattcggcgtatttaaaataaggccattctttttttataagatagccgttttgcaatccgtgacgtatgacttgatcatccgaatccattccctgcttctttttataagcttttgccgttaaatagatatgaatcaactcattgacaatggccgtgttacagtgaaacagatcttcccagcatgacttatcaacgaaagcggaggcaatcctttcagtatgttcttttacagcggaagaatggctcgtctttctgtagtatttgcagaagccggcaaacagctgaatgctcttttgatccggaagcgattgttcagcaaaagataataaaaattgatccgtctcttcagctaatctgttcaagttaatcgttcctttctgctctaaggcaggcatgcgcggcacccgcggcgacaagtgttgtatgatagcaatgtttaaacacatcttctcttcgctgttcacctttcaaaccgggtttatgttgataggtgatgctcgggacattcccctctttcattcggccccgatagattttattccaggctgcttcatagagcggtttatggttgtccttatccatgtcgatatgtaaaaaagagctgcacatcaataattcactggtaatatctaaattctcaagacagatatagatcccgagaaatttcaggaccttttcttttaaggacgacagatgatactctttatccgtaagagaagaacatcccatgtctgttatataaaaaatcgtatgagtgatactgtatgcatcatgatccgtcatatatgtatttgggatatcctgaccagctgctgtgtagtgatataagtcagaaaaatccgttatttccgaggttacgcctgctctttgcagactgtacttcagatccatttttcgaaagggaattttagcaaggctgcaatcaaaacgcgctgccgtgaatttttccagctcccatatcactgaagcttgtgacggatgatcagtcaaggtaagaaattcacccgcaatagccaatccggcgagaccgtccggatcaaaatgaataaattcttcaagctgatcattacggagtctttctgtaataaactccgttaaaacagcaacttccttatcatctgcctgatttctgatcaggtaattggtaagaaaaatgagttctataaatgttttaaggcgccatctgaaatcattcgctactttatgattcatatcaaaataatggatattttcaacaatccatgacagtgctccccgcttaatttctcttatatactcttgtgtcacactctcaccgcctcgtctcgaatgcgtaggctccaaacagtcattatcttacttttgagcggctaaatcagagaaattcaaattcgggttttgattgtcttcttggctcggcactacaagcacccagccgctccaagcgaaagaattgcctgattgttccgcatctccggctaacaaatgtgtagggatcgtgattcttttttcttcttttatttttttaaagttcatatctccatctccttcagtttatagaattatttggaacctacacaaatatattaatcaaataaggtatataatgtaaactagttttgatataacgattctttttcactataactgaatagtatataattaccaaaaataaaaaaagcccggactcagtccaagctttcctgcgtgccgaacaccttctcattccgttccagcattcggatcagatttttttcaaataccatttcctcttccggcgataatccggctgcatacaggcgtccgctgagttccttcagttcagtcaaaagcgccagcattaagtcctgcacggtaatgtccgtttgcagcaattcgcttaatgaagccatcgtttcgggccggatatcgggatatacgccttttgtatcgttgcttttgtcttttaaagcggcttgatagaaacgtctgatcagatcggcgcgttcgcttccgcttttatcggcgcagaggtaaatctgaaccgcggttccgccccgcaggcgtctttgtgagattcccgcgaattttcggccgccgatgctgagatcatagctgcccggacagtacgatcctttaatttcatatgcttcaatttcggcattgtacggacgcagcatccgccgcaccagctctgtcatcgcctcgtagcctctgtcaatgtcgatgccttttttctcatcttcaaaaataagagaaatattcaatacgccttcatcgagaacgaccgcgaggcccccagagttgcggacaatgacacggtagccttcgccctccagcaatttcacgccgtcctctaaaaacggcaggcgtgtgtcctgaatgccgagcacgatcgtccggtggtgcacccaagtgcgtgccgtcgcaggcgattcccctttgcctacggaggcgcacagcgtatcatccattgcgaatgactgcttcgcatcaaaataagggccgaggctggattggtcaatgattctccagctcggctgcatcagtaaatcaatcggttgctttcccatctatattaaatccctttcgtcataagctttccatgcgtttattatatcactccgcttgagatgattgaaattggcttttcaaaagagcgatgaagatttctttgttttttgtgttctccataatggaagattggatgatagacagtttccgttttaaggagaatccttttatctcaagcacggaaatgctgccgtgaagcagatccttttgcagcacgctttttgacagaacggaaagacccattccgctgatcacggcttccttgacgccctggttgctgctgatcgtcatcatggatttcggccgcagtccgtttgattgaaggacgtggtctaaatattccctcgttcccgaacccttctcccttgtcacccacgcttgattttgcaattcggcagccgggatgttttttctgccggcgagcgggtgtccgttcggtgcggcaatgcacaattcatcctccataaacggctgaatgtcgagctcatttttccccgtatgcccttcaattaatccgatatcggcttgaagcatccgaaccgcttcgctgacctcctccgtgtttccgatcatgacgtccaggttcagctcgggatactcgttatgaagctttgcgagaagcggcggcagaatatattcgccgatggtaaagctcgcggcgattttgagcttccctttgacataatgatgatgggcgtaaatttcggatttcgcctgttcgtacaaaaagaccatctgcttggcgcgctgatagagaatgtcccccgtcggcgtagtcgtaaagtgcttcggagagcggttcagcaaagcggtttgaaattctttctccaggtttttaatgtgaaggctgacgcttggctgagaaatcatcagcttctgcgccgcctttgtaaagtttttttcttccacgacggcaatgaatgttttcagttccccataatacaaaaagcatcgcccctaatcattatttttcctaatcgtttagatcatataaatatattttactaatgattaagaccgcagtaaagtggagttatcaagataatgggaagtgactgagatgaagatgataaagggtatttcagttaccgcaggaattgcgtttgcggccttctatgtcagccgcctgccgtttttgcatatgctcggaatgcttgtccttgccatgctgatcggcatgctctggcgcgccgtattcggacagcgggcggcattagagccggggatcgcgttctcaagcaaatacttgctgaaagcaggcatcatcctgcttggcatgagactgaatctggcggatatctatcatgcgggctggcacgtatttgcaattgccgtctgctgtatgatgtttgcgggtgccgttgtatacggactgtcccggctgttccgtatagatcagacactcagcacgctgacagcctgcggcacagcgatctgcggggcggctgccattgccgcgatcgcgccgcagatcagatcaaatgaaaatgcagccgccgtcagcgcggccgccgtttcgttattaggaaccgtttttactgttgtatattctcttgcttatcatggattggggttttctcctgcggcttacggggccttttgcggggcaacgcttcacgaagtggcgcatgcggcggcggccggcagcgccggaggaaaagcagccgtcgagatggcggtgatcgtcaaactgacccgggtcgcgctgctcgtcccggccgcattcatgctcggaatgcgggcgcgccgcagcggaaagtcaaagacggcttctgccgcttcgctccccatcccttggtttatcttcggatttctcggaatgagcgccatccatacatcaggcgttatttcagcttcgttttccgcgtttcttgttcaagtgtcttatgttttaatcggcatggcgatggcgggtctcggtttgaaagtccatatatcggcgtttcgtcatagcggctggcgggcgctcgcagcaggcttgatcggttctctctgtttgtccctgttcggctgggccgcagtgacattctttctataaaaaaagccggtcctcgtaaagaccggcttttgcggattacagcgcttgagcagccgtaattaacgcaagattgtagacgtcttccgcattacatcctctggaaagatcgtttacaggcatattcaatccttgcagaatcggtccgaccgcttcaaagccgcctaagcgctgagcgattttgtagccgatgtttcctgcttcaaggcttgggaatacaaatacattcgcgtctcctttaatgtcggagtccggcgcttttttctccgcgacagacggcacaaatgcagcgtcgaattggaattcgccgtcaagcgtaagctcaggcgctttttccttcgcaattttcacggcttcagccactttgtccgtctcgtctgatttcgccgatccttttgtagagaagctgagcatggcaacgcgcgggtcaatgtcaaacatttgagccgtattggcgctttcaatggcgatttcggcaaggtcctggctgtcaggagcaatgttgatcgcgcaatcagcgaacacatactgctcgtcaccgcgggccatgatgaagacgcctgatgtttttttcacgccttcttttgttttgatgatttgcagtgcagggcgcaccgtatcggctgtagaatgtgcggctccgctgacaagtccgtccgcgagacctttgtacacaagcatcgtgccgaaatagttttcgtccagcaaagctttgcgggcctgttcttccgtcgctttgcctttgcggcgttctacgaaagcctgaacgagttcttccatgccttcatatgtatgcgggtcaaaaatgtccacgccgtcaagcgtaagatttaattctttcgcttttgcttgaatgtcttctttattgccgactacgatcggctttaataccttgttgcccgccaagttgttgaccgcaaccaggatacgttcgtccaacccttcaggaaatacgattttcacatcttttcctgcgactttttcttgtacttttgtaaataaatctgccacgatattccctcctctatgttgacaaaaaacgcttacttttacagcatactcttcttccagctaaattcaaataaccaacttctattatagcgctttcaaaaagaaatcttatttttctaactaatttaattgacggtttgtttcacggcttagtttctgacacaaggcttcggattattcaaggtttctccacagccgaaacggttaaactgtgatatagtgaaggcatcaatgtaatgaaaagatataggagtgaagatacatgagtgagcagcaaaaaacgaacgaagccgcccaaacacttgacggctggtacgcgcttcacgatttccgcacaatggactggacgtcatggaagatgttatccagcgatgagcgcctgtcgattattcacgaatttacgggactgcttgaaaaatggggcatcgcccaaaaagaaggcaaaggctcgcaaaccatctacagcatcgtcggacagaaagctgatttcatgctgatgattcttcgcccgacaatggaagagctgaacgaaatcgagcttgaatttaacaaatcaaagcttgctgaatttacgatcccggcttactcttacgtgtccgtggttgagctgagcaactacctcgcaagcggagaaggcgatccgtatgaaaacccgcatgtccgcgcacgcctgtatcctgagctgccggaagcgaaatacgtctgcttctatccgatggataaaagaagaagcggcaatgacaactggtacatgctttctatggatgaacgcagaaacctgatgagaagccacggcttgatcggacggagctatgccggcaaagtcaaacagattatcacgggatctgtcggttttgacgattacgaatggggcgtcacgctcttcagcgatgatgtgcttcagttcaaaaaacttgtttacgaaatgcgctttgatgaagtcagcgcgcgctacggcgaattcggttcattttttgtcggaaaccgcttgtctctcgacacgcttccgaagtttttgcacatgtaacacccacccgcctgtccggcgggttttttctttgtcagaatttaaataaaatttgctatttttatcatttttttttacgatgtaaaggagattccattttggtaaaggggtgcagacagttgtcaaaacgaaccgcatttattatgggagccagccaggggatcggcaaagcgatcgctctgaaactggcggacaatggcttttataccgtcattaattcacgagttcccgaaaatatcgaatcggtaaaagaagagatcctcgccaaacatccggatgcgggcgtcaccgttctggccggcgatatgtcggaccagaaggcgagagccggcatttttgaagagatcagatcacaatgcggacggcttgatgtattgatcaacaacattccgggcggctcgccggatacctttgaaagctgcgatatagaggatatgacaaatacctttacgaataaaacgatcgcctatatcgactctatgaaaacggccgcagcgatcatgaaacagcacgaattcggcagaatcattaatatcgtcggaaacctatggaaagaacccggcgccaatatgtttaccaacagcatgatgaacgccgctttaattaatgccagcaaaaacatcgccattcagcttgcgccttttcacattactgtcaactgtctgaatcccggatttatcgccacagaccgttatcaccaattcgtaaagaatgtcatgaagcaaaacggcatttctaaagcggaagcggaggaacggattgcctcaggcgtcccgatgaagcgtgtcggaactgcggaagaaaccgcggcgctggctgcctttcttgcctctgaagaagcctcctatattaccggacagcaagtgtcagccgacggcggcagcatgaaaagcatataataaaaacatcccgctctcagcgggatgtttcttgtaatgaaggaaaggacaaacctagcttttgaatccgcagcacgaattcccttaaatcgccctgttttgccaccattgatattctgacataacgctttccgccgctgccgaaaatctcgccgggcgtcacgacaacatgggcatgctccagcagatagtctgaaaactggtgtgaagactcgaattcattcggaatttcagcccagacataaaaagtccctttcggtttttcaatgctccagcctaattccttttcacataacgccgtgaaaaaatcaatccgttctttatatgtgcgcttcagacgctccgtatgctcaggatttcctgacagcgccgccgctgccgcctgctgaaggccgccgaacatgccgacgaagacgtgatcctgaaactcattgaccgcctgaatgattttctcattccccacggcaaatgccattctccagcctgccatattgaaggttttcgaaaatgaataaagctccgcgccgaccgttttcgcttctttcgcctgaagaaagctggccgggttctgatcaaattcgaacgcgccgtatgcaaaatcgtgaataagatggatgtcatgtttttttgcaaacgcagccgctttttcataaaacgcctgatccgcagtcgcgcccgtcgggttattcgggtaattcaaaaacatcagcttggcttttttcaggacggcgggatcaatccgctcaaaatccggcaaatagccgttttccggatgaagcggcatctcatgcagctccgctctggccattgtgattcccgataaatactcagggtagccggggttcgggactaaggcgatatcgccggggttcagcaggcattgcgtcaaaacgtacaaaccagctttccctccgccgaacagcgcgacttctgtctccggattgaccgataccccgtactctctctcataaaattccgcgatggcttctttcagaaacggatagcctctgaaagggccgtatccgtgatatgaaggattcagcgcagcttcccgcaatgcttcaacgatatgcggcggagtggggagatcgggattcccctggccgagattaataatctgggctcccgttttctccatctcttttaccttttgaaaaacgagcgaaaattcctgtttcggaagtgtcttgatgacgtcggacggtatgatttccatctgaaaggctccttataaatgaatttgctctgattcgttattccgttctgaaaaggatttattgaccagttttgtatgcagaaacagcccgctgaccaaaaggacgataaacgccatgatgactgccgcgtctacaatgttgatcagcatggaaccggcggcgatgcacaatccgatggacgcctccgccaccgaaaagatccggccctgaatctggttcgccgcgttctcctgaactttgacctttgccagcacttcaccgtattccattgcgataaagaaaagaatggcggcaatgactgacacggcgaaaatcggggtaaacaaaaacagcgcaagcgagacgatcgataacactgtaaaatacatcagccctttattgttgttaaagccccatttgctgacaagagcggcgccgataaagccgccgaagccgatacagaacgtcaggatgaaattgccgatttccccgtcgcctaaaaagcggctgacaatcgggaaatagctgtagacgacaccccacaaaagcgccatcgtaatcatcgtgaacatggcgtttaacacaaaagcatttgttttgatttccttcaggccttctttaaacgactgaaaagcttctcttacgttttctgactgaatcggcacgtattgaagcttaatgcggctgatgaaaaacgcggagacaagataggtcaccccgttaaacgcgacggcaagctccacagaaccgcctaacagaaaaagtccgccggctgcagcgccgacaataattgaaatcgtcgtggcttttgcaaacaaagtgttgatatttttaatatccgcttctaaagacgacatgaccgcgagacgtgccgggttaaaaaacacgccgcttccgtacgagacaaacagcagcgccagaaaaagcagcggatattcgcctttcgggagaaatgtcagccccaaaaagatgacacctctgatcacatccgtccacagcatgattttcaccctgtcgagcctgtccacgagcacgcctaaaaacggctgaaacaccatcggaatgctgcggaccgcgataacgccggacgtcacccagtagtcatgatagtatgtagacaaaatgagcagggccgggagaacgcaatagtctcccataaacgaaagcgcctgcccgaaaagcaaatacttcgagttcggtttcagctgtttcataccggtaacgcatactttgcagtcagcttcgcctgctgctgaatttgtttgattgattcggccacgtcacccgaattgcttcctttcagctcaaacgccgcaatgctgttgaacgcttcgaacagccgcagatccacggatgtacccgcctcggcagccgagaaagaaacgagttcggtgtctccctttaagacgccgtcgggaatgtcaatgctttcaatgacgaaatcgacagctgtctcaggcagctggccgttctctttgaaatgctgaggatacaagtggcagtcggcgacataacatggctcctgctccaataatcctttcggcagatcggcttcttttccgaaacagagaacatccaataacagctgcgccatatcgacgccgaagacctttttaatattcggaatcatgttccagcccgcaaatcgcgccgctgattcaatcagtccggcttcccggtttttcattaatttaatttctgtatgtgtcgcgcagttttcgaggccgagtccttcattcgcctttttggcagcttcgacaattttccgctttgcgtcatcatccaggatggacggcgtaatatgcgatgtctccgtgaatccgatttgcggtgttttatcatgaatcgccacagggaagtattccccgtcggccatgatgccttctatgctgatatagtcggaataaccgcttgtttcgtaccagtcgtcatactcgccctgcaaaaattcttccgcgataaaaggcgcttcaaacgtgaccgctttcggtacgttaatcgacttcaggtattcattgactctgttaaattcagcttctgccgtttccctctctttgatgagcgtcacgccgatggagctcgccagatatgtaggcttcagaatgagcggcgttccgatttcctgaagcgcggcgcggaaatcttccagcgtcgtcacccgtttatttttgatggacttgacgccggcccggttgaaggcggctctcattttgtttttatctctggcattttcagcggcctgtacgcccgctccccgcaggccgagacgttcacacgcttttgccattggagcgataaacagttcattgttggtcgtaatggcgtcaaccccgaacatgtcagccaccttgacgatttcttcgacgacttcttcctcaggtttgtcatgatcttcatgagcccagtaaatcgaatcgggatgctcaaaatcagccagactcttaaaatagtctttatctttaatgaccgcaatcgagtatttttcaattaatgccgcatgagaggctgtaattgcaaaaggtctcggaataaagctgacgaggttgtatttttcggctgcgcttttgtaaaacatatgcggcgggcatcccccaaggtcagcgataaccaatactgtttttctctccatatgtaaacactccttctctattgtgcggtgtatccaccgtctgcggtgatcgcgcttccggtcatatagcttgataaatccgaagcgagaaacagcatgacgttcgctatttcttcaggcttgccgagtctcagcagcggattgactttcgctttttcttttttgatttcttcaagcgtgccttcgttgttttcaaggaacgacttttcattcaaaggtgtgtcaatgattcccgggcacacgcaattgacgcggatgttgtgtttggcgtaatcgacggccatcgaacgcgtcagctgcagtacgccgcctttagaggcgttatacgcgggaatgtcgggccatgcgacgactcctccgacggagcacgtgttaatgatattgcccttgccgcttttgagcatatacttgagcgcgtgcttgctcataataaacatgcccgtcagattgacgttgagcactttgtcccaatcgctcagctccatctcatgaatcggggcgacaatttcgatgccggcgttattgattaacacatccaatccgccgaacttgtcaaccgctgaccggatggcattttgacaggccggttcatctgtaatatccgtctgcacaaaatgcagcctgtcattgttttctttccggatcatcgcttctccctgcgcctcatcaatatccgcgacgaccacattcgcctcttgattcagaaacgcctgaaccgcggcataaccgatgcctgatgcgccccctgtgatgaggacggttttatccgtcaggttcatgactctttcgcctctaattttttcgcttttgctctgttatagcgcggagggaaaaagatattgactgattttgaatctttttcaaatctgttgatggcgccgtgatcttctctcggatcgcagaaataagctgtgccgaatgtcatatccactttgcagccttcaatggtcatatcatagccgccgccgatgcagatgccgatctgttcattgcggtgtttatggaacggcatttctcctccgttgcccggaatgttggcaagcatgatttccacccagtcttccacgaagaacgtgacttccatcccaggcaataagtctctcgttttaaaaatattcaaaaaataatcctcagggcttgtataggtttcaccggctttcaggcgtttaatatcaatggcgatcacttcttgatccgtctcatttcttgcgccgtgaggcacgttaggaggcgcgatataggctgattccagcgctgtcatctttcttgtgacatctccgacagtcatggacagctcgccggaaacgacaaggccgatttggacttccttatgctgatgcggttccacgtttgtatgcggcggaacgtaagaaagcagaacttccgtatcgcctctgacggacgaatattgtcttactccgttatcccattctattaatttaggcgtcgggaaataaagttcctgcaaatcttgttcagttttcatcatgaatctctccttttccgaataatgaccagctcattggaatgcttttaaatgttttgacaaagtgaaggccgtacttttgtctggccagctcatttgtcagcgcgatgtcggacaaaccgtccttcactcttttcgcggctgcgctcgttgagttcaccagatcaaacgtgacatctttacgggtaaaatacttaatcaaattgataggagacgggtgggatacgatgacagtcttatcaagcatgtcatccgtatattcaaaaccgggccggacagccaggccgtacatcggggtgtcgcacctgaaaatttgcagaagctgcagatccggtctcatgtagaagtgcttaatgccgtcatacgcgtgaggcacaattgtgtattccagcggactttgaagcgttttttcaatgcacgattcaaatgtatcatgcaatgataatttgctgttcaccccttggagaagggtgaaattggtgatgaagttttttgctgcgtactcactgcttgtcccttcaggaccgagcgtgttgatcgtaatcagtttagatattgaataagccttgctttttgtttgaatgctattatccaatataatcatgagcaccaaccaatctgttaaattttaagtaaatattatccatagacgttcaagctgtcaatattatttgaaaatattgataattattcctatatattagaaaacaccttatgatataaggtgttaaaaatttacatttacaaaattatagaaactttattttaccgatacaatgattggtcggtcttatgctcatattttccataccttctgtatgcgaaaacgctgaggacaaagccgatgagggtgacggccgcacagataaatccgacagctgcatatccgtatccgacatagaccggacccatgacagcagaacccaaggtgacggccaaattggacgccagactgtaaaatgccatgattttgccccggcggctctgtgagcaatcacttaaaatagtgctgagcaaggtcaccgtcaggctttgcatcaatccccagacgaataacccgatgaccaaaaacggcattgatgacggcgcataggcgagacaggaaagccatatgctgatcacggccaatgccgcgatcaaagagcgcattttccccgccttatctgcgatttttccggtgaacacgctcatggaaaaaccgattccgtacaccatgatcagcagccctgaagctgtattcccacccggcatcacgcggtgaagatatgtaccgagaaaggaatacatgccgtaaaaaccgatcatgttgcaaaaagtgatcgtgagatatacagggacacggggcaccttcagcgcatcccggaaagtgcctgcctgccgtccgttttcctcttctgttttattcccatccgccgtgctgcggcgcgcctcaatgaaaatgagcgaagcaacgaggacagacatgagggcgaaaatccaaaacgtccaccgccaattcaaaacgccgccgataaaagagccgatcggaacgccgaaaatcaaagcgagcgaccagcttgacacgatcagacccatcaccttgccgcggtacgcataaggcacacggtcgccgaccaccgcatatgctgtcggcacaaacgcacccgctgcaagcccggaaagcgccctgcccagaaagaagaaaaagagattgtgcgccagcgcgcagatcaccgtgccggccgtaaatataagcagtcccgccagcagactgagttcccgggaatatttatctcccagcggaacgagaagcggcgccccgataaaaatcatcactccgtaaatactgatggaaagcgccagcacactgacatccgagctgaaagcccgcgctaaatccggaagcagcggagaaatcaccagctcttcagaacccgcggcaaatacccctaatgtcaaagcaagcgcgagacagaccggaaatcggcgtttcgtttcgatgtgatcggtttgtttgctgttcatgctctttgaacacctcttccgtaaaacttttctaccttttgttgttttatagtttagcatccttatatttcattttacatttcacatgaaaactaattctgattttttatttacattcatattttaaataaaatatttagtttatattcaataaatgatataaaatacgccgtctggttatgctatagtgatagaatcatttgttaaggtgggggtcatgaaatgaataacgctgattcaaaggccgcccgcgcaggcctcggcatggtactgattctcgggacgctcgcttcattcgggccgctttcgctcgatatgtatctgcccgctttgcctgaagtggcggccgatcttcatacgacagcgtcacttgcgcagctgagcctgacgttttgtcttttggggctggctgtcgggcagatcgttgtcgggccgctcagtgatatgatcgggcgccggaagccgctgattctgtcattgctgctttatacgctgtcttctttattatgcgccttcagcccttctgtttcgtttttaattgtcatgaggtttattcaaggattcaccggggcggccggaatcgtcatcgcacgggcttccgcacgcgatatgtattccggaaaagaattgacggcttttttctcattactgatgctcgtcaatggggcggcgccgattttagcgccgattacagggggatttatccttcagttcgccggctggaaaatcgtatttatcgtgctggcggtaatcggctgtatcatttctgccgccgtgcttacggcgttgcctgaatcactcccgccggaaaagcggacaagcggcggactccgggagacgctgatgacgtttcgcggcctgcttggcgaccggatgtttatgggatttgcgctcagccaggcatttgtgatgaccggcatgttcgcatatattgccgggtcgccgtttatactgcaaaacatctacggcgtatcggcgcaaatgttcagcctgctgttcgccgtaaacggtgcgggaatcatatgcgccacccaaatcaccggacggatggccaaaacacatgatgaacggaagctgtttgtctccggtctgatgattgccgtcatcgggagcatcgctttgcttttatcacttgcgtttggtttaggcctggcggcagtctgcatttctttattcatcattgtttcttctgtcgggatcgtcacgacgacgggattttctttggctatgcagaaacaggagaaaggcgcgggaagcgctgcggctcttctcggactcctgccctttatcggcggtgcggctgccgctccccttgtcggtattgccggagaagaaaatgcctggccgatggccgtcagcattttcggttttcagttctgtgccgttctatcctatgttctgtcggccaaacgaaacacaaagtaaagcccgccgctttaagcgaagggctttttttcttatccggcagcgcctttttccgaagaagccggctcacgcttcaggcgttttttgataccgaagtgataatacgcgtaacagatgatcatcagcgggacaccgcagtacagaccgatacgctggtcggggataaagatgagactgattaagataagaccgtaaaccgaaaatccgagaatcggcacgatcggataaagaggcgttttaaatgccaggtccttcagatttcctccttcagcgagaaagcgtctccggaaaacgaattgtgaagcgcagattgacatccacgcgacgacggtaatcataccggagatggaaatgagccacacatacaccgtttcagccgcgactacacttgtcagcagggataaaccggagatggcgatggtgatgaaaagagctttcagaggcacgccttttttcgtcagtttcgttaaggaagcggggcccatcttagtttttgacagggaccacatcattctggacgaagcgtacagcccggaattcgccaccgacagcatggcggtcagaatgacaaagttcatgatatcagccgcataaggaacgccgattttatccagcacagccacaaacgggctttcgatgacgcctgccgtttgatacggcaaaatggacacgagaacaaacatcgccagcacgaagaaaaaaagcgtccgccatatgacgtttcggatcgagcggggaagcgtcttttccggattttcgctttctcccgaggcgattccgaccagttcggtaccctggaatgaaaaattcaccataacaagggtaaacagcacggcttgggcgccgttcggaaaaagccctttgtccgtcgtaaagtttgacagatacggagccgtctgcccgccgttaaaaccgacaaagccgaataccgcagcgcagccgagaataataaacaatacaatggccatgaccttaatgctggaaaaccaaaattccatttccgcaaaactccgcgcagacagcgcgttaatggaaaaaatgacgacgccgaataccaggcaccacacccaaatcggaacggccggaaaccatcgctgcattaaaatccccgccgacgtcagctcaagccccactgtattggcccagctgaatgcgtacatccatccgatcgtaaatcccgtcgacggcccgagaaactttgcggcatacgcctgaaatgatcctgcgaccggcatggcaaccgcgagctcccccaaacaaagcatcaccaggtacattaaaaatccgccgatcacataagccaatatcgcgccgatcggtcccgcttcactgatcgtaaaaccggagcccagaaaaagccccgtcccgatcacgccgccgagggcgatcataaacaaatgccggcccttcatcgtgcgcttcaattcagtttggttcgtatctccctgcatatacatcccccttattccgtaatgtcagccatttgtgcgtatgtctaatcggcagctgtgcaaaaggtgcattgtcgtctgctgaatgagttccggcagcacatggaatgtgtacggtttgtacacgcgttccgtccatttatggccgtcctttccgtatacccctatattgaccgacggaatattcaattccctgatttcattaaaaggaatcgtcccgatgacatcccagcccggaaaattatcggtaaaggcggagacctcctcatctgtttcatgcagcgataaaaagcttccgtccgctaaataagggaaaaactttttaaagacgaatgtttctccggttgatgccgctgttttatcgaccgcttcttgaatgacatgctgcaaaagccggtcccgtgtgctttcttccttcagataattgtgcggaaggtaaggcggcgcatagaaaataatgaccttggctccctgctcaggatcgagtttttgcagttcttcgacggctttaaaacatctcatccgcagttcaagatgttcatatgttttaaatgcctgcccgatacactgtgcagggtctatcccgcggcttctcagccttttcaggtaatcttccagactgtacacttgaacgttccatgacatctcttttttcggcaggctcgttctcttacagtattcgtcgtaataatcagataatttttgttctgtctctttgcaggcttcgtcagccacggcggtcagctgatccatgacttctttggcggttttctcgtaaataaaataattaaaatagacataactgctgacggcagtctgcacgttatacgcttccttattgtcacgctggtagaggcaggtcggcggaaggacaagctccccttcaatgttttccgccatatgaatattgttgtgaattcttctggtgatttctgacgcgatcaaattcggatcgatgccggacagcgtatctccgacatgcacctcccgcccgtaaatcgcaaagcaaggcaaaagcttccctgccgcacccgtgtatatgtaccttgtcgtgtcaccctcatacagcggcgtgataaaatcgttattaatcgctgctaaataacgaatctgcttttcttgtttcagccgttttaattcagaaatgctggttaaaatgccggaatgctggctttcttcatccgggtttgccatgaacagaatatggcccggcagctgatcgcgccgttcagaaaagtgaagcagattggcgagatgaacggcaataccgctctgcatatcaaccgaaccccttccgaacatccactcgcctgagcgggcgtcccgctgcacatcccgatcaaattcatagtttgagaaatattccgcgagacggtcggaatcaaaagcgatatcttttaaagggccgaaatcctcgatgccgaccgtatcaagatgagcgtgataaatgaccgtattcaggctttcgccgtttccctcaataaatgcgaaaatatttttgcggccgtaagggtcctcaggaatcgcctgctcccacacatgtgacggattctcctgaaagtagggaaagctcttgatcatatctttgatatagtcggctttttttccttctcccaatgtgccgttgatgctgtttaaggccaccagtgatttcgtaatggcttctattttctcctccggaagcattttgctgagctgctgatacatattccatcctccttaccctcatatagagaaaatagcgcgactctctttttcatcgcgctatttccgaaagattaataggcttcagacgttgtttttgcctgcatatgaagaatcagatagtcaggtcctccggctttcgaatcggttcctgacatattgaagccgccgaacggctggtatccgacaatcgctcccgtacagccgcggttgaagtatagatttccgacgtgaaaatcttcgcgggcgcgttcaatgtgcgcgcgggttttcgataacagagcgcccgtcagtccgtaatcggtattattggcaatctcaagcatatggtcgaaatcacgggcttttgagatcgcgacgaccggcccgaaaatttcctcctgcatcaggcgggcgttttcatcaacatccgcaaaaatggtcggctgaataaagtatccttttgaatcatcaccttcgcctcccgtcaggagttttccttctgttttgccgatttcgatataactcatgactttattataagatgcttcgtggatgactggccccatgtatgtatcaaaatcttccggacttccgacggtgagtgattttgttaaagcgacggctttttcaacaacttcatcatagacgtcctgatgaatgaccgcgcgcgaaccggctgaacatttttggcctgagaatccgaaggcggaatacacgattgaggaagcggcaagatcaagatcagcatctctgtctacaagcaccgtatctttccctcccatttcggcaatgacccgtttcagccacttttggcccggctgtacttttgcggcgcgttcatagatgcggcatccgaccgcgcgggagcctgtaaacgacacaaatctcgtcttcggatgctcaaccagatagtcgccgatttctcctccgtcgcccggtatgaattggagcacgccgtccggcagacccgcttctttcatcacttctacgaatttcgccgccacgacaggcgccgcatccgccggtttcagcagtatcgtgttgcctgttacgatggcggccgccgccgttccggccataatcgcaagcgggaagttgaatggagaaatgacaattcccaccccaagcggctcatagtgatactgattatattctccgtcacggctctttacaggagaaccgtctttcagcttcagcatctgacgggcgtaatactctaaaaagtcgatcgcttccgccgtatccgcatccgcttccttccacggttttcccgcttctttcaccaggtacgcggagaattcgtgctttcttctgcggatgatcgccgccgctttaaacagcacattcgcgcggtgttccggccgtacttttttccatgtttgaaatgcctgcagcgcagcctgcatggccttttccgcaagttcttttccggctgccgatacagaaccgatcacttcttttttatctgccggattgacggaaatgatctttttatccgtttcaatcgcttcaccgttgatgataagcggataatgcttgccgagctgtgaattcacataagccagcgcttcctgaaacgattgtttatttgtctcttcctgaaaatttgtaaatggttcgtgtgcgtatgaaactgtcattagaattcctccccgtattttgtaatgtgtgctcacgcttaatgaagatgcaagaagcataccagcatagcaatttgtgatcaaaaaaagaaaatctttgccgaaagcggacgaagcttgtccgaacctgtcagctgcaatctgaaaacgcaaagaaattttgcgatccgctatataactgatgcaaaatctctttgcggataacacttatacccagccgcggaaccgggccgcttcagccgactttctgatgcccgtcatataggcggccaaacgcatatcgactttgtgggtatgcgctgtctgataaatggattcaaacgaattcaccatgacgctgcgcagttttccggcgacttcctcttcagaccagtaaaagccttgattattttgcacccattcaaaataagacaccgtcacgccgccggcgcttgccaaaatatccggcacgagaagcacgcctctttcattcaggattttcgtggcgtctatcgttgtcgggccgttcgccgcctccacaatgattgaggctttaatgtgatgggcgttttcagccgttatctgattggagattgcggcaggcacgagaatatcacagtccttttccagcagctcccggttcgttatgacatcagagaagagattcgtcaccgtgccgaagctgtcccgcttatccagcaggtaatcaatgtcaaggccgtcagggtcatacaaagccccgtgggcgtctgagatgccgatcaccttggcgccggcgtcatgcataaatttagcgagaaagctccccgcatttccgaacccctgaatgatgatccgcgcattttccaatggaatcccttttttcttaacggcttcctcaatacaaatcgtgacgccttgcgcggtcgccgtttcccgcccctgtgaaccgccgagaacaatcggtttgcccgtaatgaatcccggtgaatcaaattctctcaggcggctgtattcgtccatcatccatgccataatctgcgagttggtatatacgtcgggagccggaatatcctttgtcgggccgacgatctggctgatcgcgcgcacatatccgcggctcagccgttccagctctccgaatgacatcgtccgcggatcacagatgataccgccttttccgcccccgtaaggaagatttgtgatgccgcattttaaagtcatccagatggaaagcgccttaacctcttcttcactgacttccggatgaaaccgcacgcccccttttgtcgggccgactgcgtcattatgctgtgagcggtagcccgtgaaaacctgtactgaaccattgtccattttgacggggatgcgtacggtcaaaagccgcatcggctctttcatcagttcatacatattgtcaggatagcccagtttgcgcagggcttcttttatgatcgattgtgtggacaagaacaaattaagaacttctttttcttcatctttctgattgcttttagaaagcgggttggctgacatgttttatcacctcatcgtattttacgtgtaagcttcaattaccggcagaacgaaatgtaagcgcttttacaccaaaacccatcaatccctttcacattgtcgttacacccctttttatatgcaagattcatgccaggattttgcgcataaaaaaagaggctgttgtcagcctctttcatcccggattaacgcgggtcaataaccagctttgtttcggcatagagactgccggcccccaaaccgtttacgtaatcgcctttaattgtatacgtgcccgcgcgcggaaggtttttacgcaccaggacgagattgtattcagaggcgcccaataagtcaagggtaagcggaagtctgaccgtttttccgtagttgagaatttgcgtttctttcagtgttcttccgtttacagagtccctcacagtggcgttgaacccgtcaggaaattgaaattcaacggcgccgacggcaagcagcgcattcggcttgtatgtgacttcaatatcagacgtcgcgtattctttcgtactattgacggttttcgcttcaataacggcagattgggcgttcgcatgaaaagatggcaagaacacagctgaaaataccgcagcactgatgagaaaggcagaaaatgattttctttttaacatcatgaattcctccagatcatataggattcagagcgtcctctgccggaaaagcgtgtctgatgattccattcgcgaattgggtttctcttttcctgagaataatctaccacctttatccatggaagtaaattattttttagaatattcaatcatttatttttcgcgagatgaatcagcacaaaaaaacgaagacatccgctgtcttcgtcttgtgcgctaccggtgagccgtctgccagtcaaatccgatggtgtcatcattccacgggattcttttttcgtcaggctgatccggattgtaggacattgtcgtgaaataaataatggtcagcggggtttcgcccagcactctgtacccgtgtgcgacgcctttgggaatgagaaggagcatcggattgtcttctcccatgtagtagacatccgtttctcccttggttgccgactcttcgcgaaggtcatgcagcacgacctgggcgtggcccgtcgggaaaaaccacaggtcatcctgtttctcatgatagtgaaacgctttaatgacgccgggatagcttttggaccaggaagcctgcccgaaacgctctaagagatgttcatcgtcacggacgagttctgagaaaaaaccccggtcatcgctgtgtttgatcagctttttaatttttacgccttcgatcacttgcactgtccctccctttgtaaataatcctgcagcgcttcccgccaatgcctcatgccgagcccctgccgttcaatcgactcaaggctcaacaccgagtaagcggggcgcggcgtctcatttccgtattcctccgtcgtgacgggcagcacggcgacggttctgccgctttcttcaaaaatagccttggcaaattcataccagctgcacactccgctgtttgcggcgtggtacaagcccggcggcctgtcaaacagaccgatcaccgtttcggctaaatcctttgtgtacgtcggcgctccgacttgatcgttaacgacacgaacctgatcatgtgtatccgcaagtttcagcatcgtattgacaaagttgtgcccgccgctgccgtacacccacgacgttctgataatggtgtggttttttcccgttaaccggatcagttcttcgccgagttttttgctttttccgtaaatcgtgcccggatctgcgggatcatcggtctggtatggccgtgttcctttgccgctgaagacgtaatcggtgctgatgtgaatgaatttcgcgccggtgttttcagcctcaagcgcggcataataagcgccgattccgtttattaaatacgctttgtcgagctccgtttcacatttgtcaacggaggtgtatgccgccgtattgacgacgatatccggcttgtaatggctgaacgagtgccgcaccgaacgctggtcggatatgttcatcatcgcttttgtcaaggcgatcacttcatacccttcccgcttcagctgtcggcataactcccgccccagctgaccggccgctccggttactaataccttcgtcaatcggatccccttctttccgattagtcttggctgtctgtataccagcgaatggttcttctcattccttcttcaaatgtgacgtcctgccgccatcccagctcatttttcagctttgaagcattgatggcgtaacggcggtcatgcccttttctgtcttcgacatgagcaaaccgttcctcgacaccgagctccttcatgataaatgacgcaagctctttattcgtccgttcatttcctccgccgatattgtaaatttcgcctagtgttcctttttccagcacgagcttaatggcgcggcaatgatcttcggcaaacagccagtctctgatctgcatcccgtcgccgtacagcggaaccggcgtgccgtttacggcatgcctgataatggtcggaatcattttctcgtggtgctggtacggcccgtaattgttgctgcatctcgtaatgatggcaggaagcttatgggttttcacataagacatgacgagcaggtctgagcttgccttgctggcggaatacggattgttcggagaaagcggcgtcgtctctgtaaaagcgggatcatccggcgccaaatctccgtacacctcatctgtggaaatgtgaatcagcctgccggcttttccctgtaacaccgcgtcagccagtcggtatgtgcccatcacatttgttgtgatgaacggctctgcctgatttatgcttctgtccacatgggattcagccgcaaaatgaatgacagcgtcatacatttgggaaaagactttgtcaatgtcctctttttcagaaatgtcacctttgataaaacggaaacggccgttcttttttaaggcttctatttcaagcggcctgcttgcatacgtgagattatccaggacggtaatctgcgcatctgtttctttcagcatcatctttgtgaaggtaaggccgataaatccggcgccccctgtaattaaatatgattttggcatgattaatgctcctgtcctttctgtaatgcctgatgcgccaggcttccggcgaggtagagcgattcatgcgtgcccgcatccacccaccagcccgttaacacatcatacgtcagctcactgtgttcaatgtataaattattgacatccgtaatttccagttcgccgcgttttgaaggggaaatttgttcaatataagaaaacacttctgcatcgtacatgtagatccctgtgacgcatagtctggtcggcggctgctccggcttttcaatgatcgacttgatccgtttgttttcctcatcaatctcggcgatgccgaagcgctccggatcgtccacttctttcagcagcactttcgctccttttccctgctttgcgaaacgctccgtataagcttttaatgaatcttcaaaaatattatctcccaaaagcagaacgaacggatcgcgcccggtaaaccgctttgcgtatgataaaccgtcggaaatgccggatgcggctggctgaacctgatatgtgattgagacgccgagctcttctccggtttcgagaagtttatgaaattgcggaatatattctttttgcgtaatcagcaagatatccgtaatccccgcttcttccagcttcatgatcgaccagtaaatcatcggatatggaccgacagggagtaaatgcttattgaccgcttttgtcagcggcataaggcgtgagccggtgcctccggctaagataacacctttcacatgaacacttccttacgtgtggttttatcacaaatcataaagaatcgccgccgcccgtttgatgcccctgccgtcaaccagcggctttccgttctgatgaagcccgacccgtctcggataatcagcagccagctcagacatatgccgagcgagcacgcccgccgcggtgtgttctcccaggccgagatgaacggcggcctcccgtgcggcgaatttttccgccgtctcagtttgatgctccacttgagaaagaacgatgcagggcacacctgtacaaatggtctcatataaagtgatcccgccggacacgacggccatatcagtcctcgtgagaagcgcggccatgtcatttgtctgccttaccatctcggcataaggcatttgtgtgagatgcgcgcgcacgtcatcagcatgaggcgccgcgccgcccatgacgatgatcactcgtttccgctgaatatcagggatgcggcggcatgcttccatcactttaaagacaagcttcttcgggtcacttcctcctaaagagaccaatatggtccggcattcttttctcagctgatagagctgctttgctttttcaaaacccggatgaagaatcatataatccgggccttcatataccgcggcgctgcccatttgaaccgtccggcttttcagcccgccgtaaatgccgtttataacggcatcgcataaatgaatgacatgttccctcttttcttcaaataagacgatacgagccgatgaatgctttttgatttcctccagccagtcacacggcatatcgagcagatcgaatatgagaaggtcgggagcccgcgtgtttatttcccggacaataaattccttctgtcccttgtcaggcttgatgatcacttcccattgatcagatgacagataagaagaagcctctttatttgtgtagaacgttattgagcagttgttcttaatggcaccggcaagcagcttcatccgaaccgcgtgccccatgccgatgtcacggcccccgtccgcgaaaatcaaaacccgcatgctaatcagcctctttttgccggatcatttgattaatagccctgagctccggatcacgattcagcagatggatcaattcttttgccggaatatcaggacgcgagcccgcttttacgtacagctcgcgggccagcctgtagtcctcttctgtatcgacggtcatccgcaagtgaggagcccggagttcctgcgggggctcaggaaagagaagccggtacctctcaggagattctcttatcaaaagggtgacatgctcctgatatttgtccgccagcgttttgtccgcattgatctccgttaaaaggcgcgcgttcaccgcctcgccgccgatcccgagcggtgtaccgcagatatacgtgtagtctgcgtgctgatctaaatgcgattgaatcagaaaatcaagcagcgaagggtcgacaaacgggttatcccccgtcagtctgactgcgatgtccggttttacttgttcgatgacttgtgcaaaccggtcaagcacacgctgttcgctgccgcggtggacacggtagcggttgctgaggcagtgcgcagacagaatgtcgtcggtcttgctgtcagacgcggcgacgatcagattatcccgtgattgatcgtaaaacgcactttgacgaacccttttgacaatcatatcgaggatcgtatacccgccgatcggtttcagcactttgccgggaagacgcccgcttcccatccgcgcctgaatgataaacaaaatgtcagtcatcatatgggctgcctttcgtcaaaaggtcatcccaagtgatgcccgtgtcggcggggatatccctgaccgcacgcgcgccgtcagttaaaagctcaaaatatctcgggtgaagcccctgcggtttttggccgggacgaaggacggcaaggttttccgccgtaaaacattcgcctttttgaatcggcgctgttgaaaaaatgcctctgtaagcaaaccttctgatatccccttcaatcggtgtcgtcgttttatgggaacttcccgacagcacttccggcaccggagcgtgatacccctgccgcagctccgcttcaactgagcggatcgccgcaaccatttcttttaattcatccggattgagggcgaaggagtgatcagcaccgggcaggtttttatcgatcgtaaaatgcttttcaatcagtttcgctccgagcctgacagccgcgcacggcacatcatacggatgggcgctgtgatcggagaaaccgatcactgcatccgggaatgcggcggcaagcatgggaatgacgcttagattgctgtattcaggcggcgcgggatatttcgccacacaatgcatgatcgcaatttctttgttcccctcgccggtaatggtttggtaagcctcctgaatatctgaaatatcagcgcccgcggtggaaaagataatcggggtcttcagccccgcgacatatttcaataacggcagatggttcagctcgtaggaggcgattttaaaagctgaaggggaagtcgcatacagtaagtcggcagagccttcgtcacataccgtgcttaaaaacagcacgccttttttcttacaatattcaagcagcggttcgatccactcggcgggcatttccattgattgcaccaaagaaaaaatagagacgttttttcccgcagcggttttgtacaagccggggtctttctgatacattttgtcagcctgaaacatttggaacttgaccgcgtccgcgccggcctcactggccgcatctatcaattcaaacgcctggctcagttttccgtcatgattaattccggcttcggcgatgatgaatacgggcgaaccttcgccgattgacttcgttccgattttgcatgatgccatcagtccgcctccttcccgggccacacatgatagtagtaaaaggacgcatccgctttaaatcccattctttcatacaggcggatggctcttacattgtggagctgcgttcccgctgatacagtcttatgctgaaaacgcaatgattgttcaattatgtgcgccgctaaatggtatcccgctccttttccttcaaatcccggctttaccgccatcagatcaaggacgaattcatcacctttagacagcccctgaacaaagcccgcggtctctcccttatatttggcgaggaattgtaacgaagctctgccttccgcgttattccgcgcccactcttcaaacagacggtttgcacttttatagctgagatgggggtcctgataatacctgctttttgtaaaggcgtcgcgggccagccggctgatcgcttccgtgtcgccgggtccggcttctgtaatctcaaacggcggcgtgctgttatatacacgcaccggactgacgagcttgagaagactccctacaaaataagcgttcggaagcgactgcacgacctgcatcgcgccgatatcttcagctggtattttaataaatataaaatcagtgccgtccgcccgccttgccgcgtaaaattcctgaaacagccttttgagctgtccggtgctgtttgcggctgcaagcttcacattgatgatattttttcggaacaattgactttcccacgaagagttttcatataaaatcacgccttgaaggctgttttcttccaataaacagagcgacgattcataggcttcgggctgaatgcccttctgatgcaggaaggcatgaatcatgtcctgtgcaagattttctctcagtctgtacacctaatcagcccctttgacgatatccgtaacggctgcaatgacgtattcaacgtcatcatctgtcattgacggataaagagggagtgatacggtgcggtgataatacgcggccgcggccggaaaatcagtttccttatatccgtacgttttttgataatacggatggaacggaaccggaataaaatgaacacttgtgccgatattatattggtctttcaaagcggaaatcagatcgttccggctgatcccggcctcctgctcctctatttgaagaacatacagatgccatgcatgccgcccgtcatcactgacatatgggacggtgagccctttcatgtctctgaaagcgtcctggtagcggctagcaatttcagcccttctttgctgcatgctgtcaatccgtttaagctgatgaagcccaagcgccgcctgaagatcaaacatattcattttatagccgggcgtttcgacctcgtagtaccagcttccgtttgaagaatagcggttccacgcgcctttgctcatgccgtgaaggctgagcaccctgatctgatcggcaagcccgtcatcgtccgtcgtcagcatgccgccttcaccggttgccaggttttttgtcgcgtagaagctgaatgccgtcgcatcaccgattgatccgatcattttctgtttataagtggtatacacggcatgtgcggcatcctctaagacaaataactgatgcttttcggcaatggccagaatctgatccatatcacacgactggccggcgaaatgaacgggtacaatcgcttttgtccgcggggtgacggccgcctcaattttttcagggtctgcattcagcgtaagcggatcgatgtcagcaaacaccggaacggcgcctgtgtgctcgattgtattggctgttgaactgaacgtcacggcagacgtgatgacctcgtcgccgggaccgatccctttcgctttcagggccaaaaacaaagcggcggtacatgagttcagcgcgatcgcgtgctttgcccccgtccaggcggcaaaggctttttcaaacgcctctactttcggtccctttgaaagccagcccgattcaagcgtatcaataacctcctgaatttcgtccttcccgatcatgggcaatgaatagggaagaaaagctgatcttttttgcaccatttttttgcgctcctatcttttttatgaagggtcaacccgtctgaagctgactccggttttttcctgaagcacttggcataaagcggcaagcgaatcctgtaccgggtagttcgcggcgacaaaagcacggcgcgcctgttccgctttttgatattctgcggggctttcgcatatccggactaattcctgagcgagtgcctgcgggtcctcaaaaacaaattctccaagtgaatgataataagggtatcggcgggttcccgctgattttccgatcagcacgggcttttgaaacagcatcgcttcaagaccgaccgttgatgtctgtgtcaccgcagcgtcaacaaacgggagaatatcatacagctccatctcttttttgatgattttgcctgctttatatttccgcagcacctgattgtaagcatccagcttgtttttgccgatttcccacggatgcggtttaataatgagctgcatgttcttttggccggcaagctcttcaagcactcccgtataaaattcatcagaaaacggctgcgtggcgatcagcaccgtacgctgtgacgggagaaaagaaagtttgcggtaaaacgtgtcccgatctatcggctctcttgagaaaatctcgtcgaaacggggatgccccgtgatgatgatttgttcctccctgcagccttttgctttataccactccgcttcataagccccgaatacagcctgatagtccgtaaatacgggcagaaacgcttcatctcccatgagcgccccgtgctgaagacagatgctgacggcgttttttttcgcggacatcagcgccagcacacggctgtaaatatcctccgtcgtgccgactacaacggcggaaatcttctcggccgtaaacaaaatatcaacggcgtcaatcgcttcaataaataacgggatgtctttatacaaacgttcctgaaattctctgtttccgaaagcgggatggctgtgaagctctttcaaaatggaatgggctttttcaatataagggacggggttccctttttgtcccattcccgtcagctccaatttgcagataacgggcagcccatgatggtcaggcagactccatctggccagtaccgctgtttttgccggatcaaactgccggtaatttccctcggtgaaccgaagatgatcgaaatgcagaatgacttttccgtttaccggtttctcatctgttttcttaatgttttgccttttttgatcataataaggctgaataccggcttcaggaatatgctgatccgccggaccgaaaagctccgggttctgctccatgctctcccgaagcgccggactgatatattgataaaaattactgatcaatgcgagcgggatgtctttgtagcgaagtgactgaaaaaggtcaatatactgccggtacagcacccaatagttcgctaagtatgccgacaagccctcacccctttccaagcttttttaatgattccctcagctcccggcacgtggtctgctgcggaaggctgttcacaaactcgtttttctccgccgcgaaaagctgataatggatggattgatcggtaatataattgatatcaagctcctcagaaatcgggtaaaacggataaaaatgattcactctccagaaaaaacgggcgtcaccgatacggtaaaacgcggggctttcatcccaataggaaccgaatgccgatttgacctgttccagcacggaaaaccggtgcatgaccgaacaatggtcaatggcgcacggggcgttccacacgatccgttcggcgggcctggccgtctccttcaccgtctctttccgctgattcagatgataggttttggaacttgaatacacgacggctttttccgggtcttcatcaagctctttcaccattttctcaagccgttccggcacatacgtgttgtcgtcggtcgcatacgtcacgtactcgccctccgccatttctattgcctgattaatcaaggcggcgtagcgtgttttttccgttctttctttgacgcccgatacatcgctttgataaaaccggacgcggtcatccgtgagaaaaggacgtatttccgccaatgtcgcttcatttgagttgtcatccataatgaacagctcaaagtccgtaaacgtctgagacagaatacttttaatagagcgggccacatagtcacttttgttatagctcgtcatgatcactgacactttaggcaactcgtcacccccttttcgcacctgaaactaccgctatcatatgttccttatgcggaagatgcgctaggaatacagactattatatgaaaagtcagcattgcgcgcacaaaaaaagccggctctgatatccggaaacattggatcgtattttcttttttcgcataaatctttctttgggctcatatggtggaatagataaaaacagcagccgctctgtcggctgtctgatacttgtcaggaggtttcagcatcaagaggttttcatcaaaggaggaacaatatgaaaccgaaaaagaatcaatatcagcaaatgcaggggatggggatgggaatggatatgcagggattccagccgcagctcgggcctaatccttatccgcagcctcagggccaaggatcacaaatgatgccgatgcagcagcaaatgacaatgccgatgcagcaaggccagcagttcggcggggggttccccggccagccgcagcagcagggcggcggcagctttcaaatcccgtcaggtccatcatcgtcacaaaacgttcccggcatgctgccgattgaagagtcatacattgaaaatattctgcggttgaaccggggcaaaacggcgacgatttatatgacatttgaaaacagcaaagaatggaattcaaagattttccgcggtgtgattgaggcggcgggacgtgaccatatcatcatcagcgatccgaaaacgggcacccgctatctgcttctgaccatttaccttgattacatcacatttgatgaggaaatcgcttatacttatccgtactccatgtcttcttattctccgagataaatcaaaaagccaatcgctcacttgacagaggattggctttttttctttataaatatttgacggccgcgacgataatcataatccaagagatgataaacgccacgccgccgagcggtgtaatcgcgccgagaatggaaatctgcgtcacgctcaatacgtacaggcttcctgaaaacagaacgatgcccgcaaacatcagccagcccgcaacagaaacactgcctgcgccagagagcttttcagccaaaaacgcgacagccagaagaccgagcgcgtgatacatatgatattgcacgcctgtgtgccacacctgcaaatatttatcggggattttcccttcaagcccatgcgcgccgaaagcgcccagcgccacggccaataaagcgttaatcgcaccaagaataataaacactttcatctatttttctcccgccttttcgttaaagtttccaattcaatcataacccaacatcggcaaaattcaacgtccgtcatccgatgacacgagattgtcggattttttctttttgataagctggattcggtcaatcgctatcgccagcagcgttccgagcacaaggccgttgcttaagagcgaaatcaggatcggatgcatccctgataacgcgctctccggcacaaacattacgccgacccccgtgaggagcgccagaccgataatggaacggattcgtttttgctccgctttctcataagagtcaaactccgtaaaggcaagacccgccatcgtggagaaaacgacgaagtttaccgcaaagccgaccggtgagggcagactcgcaaacgcattcataaatagcgggatcatactgatgatcatgacaaatacacttcccaaaagaaacggctttttcgaaggaagcttcgtcgtctcaataaaaccggccgcccctgaaatcggcacaggcgcaatgccccctgacagcccgctcaaaaggtggctgatcgaagccgcaaaccctgccggacgctcacgccgtttcccaacggtgccgccgaattttttcaccgccgcttctacaacccggatgctcgcgagcatgttgacaatcaaaagcacggtaatgaagagtgacgtaatgatcaggccgctgtcaaacacgggttttccaaacggaaaaagaaccggcagctgaatcacgcgatccggtatttgaatcggtttggcagcgccgaagacggcgaataagatccatccgccggcaagcgaaaggagaatcgcatactgtcttaagaacgtaacattcgatcgggacatgatgaacatcgccgccgtcacaaccatggcgagcccgaatacaaggccgtcgacgctgttttttaaatagccgatgcccaaaaggcctttcacaatcggctgactcagctgcatgaccaacagcagcagatacacaccggtcacaaccggcgtaaacagcacggccagccgttcaatcactttaaaaaggctgaacaaaaagaaaaagacagcgcttaataacagcgccccctgcagcgcccgcagcgtctcgccgaatgtcgcaaacaccgtgcccgtcagtccgccgtaaatcgtgtatacgccccaccataagcctgccgggctttcattaatcggcagacgatgtccctggagacattggatgaccgcagcgacgccaagcacaaaaaatgtgctctgaatcaatgcggcagaatcggcatggttcaagtgaaatgattgtgcgatggcgacaggaactacaatcgcagccgcaatcataaatgccgtccattgcaaacccccgagtatcagtttcaagtcaatcaacctctcctgttaaaaatcgaaaatggaatccccgtttccgtcttcctcacgttcgtctttcgcttttttctgatattggttcagcccggcgctgcccatcattttttcaagcagcagcgggtctgtcgaaggagacgcggaaggtttcggcgccgctttcggaatcggattctgcacaggcgccggagcggtgtgcgtctgagtgccgagcacgacatcacacagagagcggatggcggccgcgtgcattttgacctcctcggtgcgggtcgccgttttcgcctgcctcagttcttcttccatcttctgaattaaagcagagatatgtatgttcatgagtaaatcctccagcagtaatttgtcttcttcctgcattttatcaaatttctaagcgaatcgcagaattgagtttgttattttttctgacggcataccgcccggaacatcaaaaaagacgcttccgccgggcggaagcgcctcaaaaaaccgtttattgcggcaggtcggggatgcaccaatcgatcggctgctcccccattttttcaagggcggcgtttgtacgggaaaacggtctgctcccgaaaaaaccgttccttgccgaaaacgggctcggatgagtcgattcaataataatgtgtttcgatgtgtcaatgcgctcttttttcatctgcgcgtgacgcccccacaggataaagacaatcggcttctctctttcattcaccacatcaatgatgcggtcagtgagccgctcccaccccttgcctttgtgggaattggcctgaccgcggcgaaccgtaagcactgtgtttaacaaaagcactccctgcttcgcccagctgacgagcgatccgtggttcggtacggggcagccgatatcgtcctgaagctctatgaaaatatttttcaaagacggcggctgtctgaccccgggctgaacggaaaaactaagcccgtgcgcctgtcctgggccatgatacgggtcctgtccgagaatgaccgcttttacatcctcatagggcgtataatgcaaggcgttaaaaatatcatggctgtcaggataaatcgtttggctgctgtattcttgtttcagcatctctctcagctcttgataatacggtttgtcaaattcatctttcagctgattccaccagctgtcttttaaaagctgtttcaaactgtccgtcccccttatgaactgtgcagtcttgaatggacgggctttccgtcccacacaatgtcagtcggcgcctcccgcctcttcatgtccggctcttctagaagaaccgcgaagtttttcgtcgggagctccccaagcccgtgcttttcgcttaaccggtctaagtaccgcttccgtttgccgccgagatccgcggactgattgccgcctccctcaaaaaacgcatatatgacgctcgcgcaaggcacacgcttcacacggtgctgtttcgcggcgcgcaaataaaagtcccagtcccaataattatggacatccggatcaaaataccctaacgtgtcatgcagagaacgtctgtacatgctgcctgacggaacgtacgtggaaaatacccgcatatccgcataatccgccgtataggcgaacggctttcgtgacaccgggtatctcgtgccgccccgttcttcaaatgacacaatttccgcgtcagaatggacaaaatccgcatcagcaagtgcagccgtcattctttccaaatggcccggcgtaatgaaatcatcatcatcgcacagcatgatataatcaccccacgcttttttcacacctgcgttccgcgcttccacatgtccggcattctgttctaaatcaataatctgaatcggcagatcgctgtacagctgcttcgcttgttcgaccgattccccggcatcatttacgatgatcacttcataaggctttatggtctgcctggaaatcgactccagcagctcacacaaagccggaatccgattatacgtgactatgacaattgatatattcatgacccgctccttctgctttttctcatgttctattaaaacataaagcggcggagagatcaggggggatttttgatttcggcccattcagaaacaaatccacgtcatccccgccagcaaaaccagaatgatcagaaggtctccccaaacagtgcataccgccttggcattaagtctgcccgcctccatggcattccacagttttgattgataaacaggcaccaacaccatcgcatagcatgtgcacaagcagacaaaagccggcgggacaagcgcacacatccatcctcatgccaatcatgaatcagttccggtatactcaccccgctgtcaatgtacaagtataatatacccgccagcggaatgagcgagctgacctgcagctcgaaaagtttcaccttccactcacgcgcaaacgaaacagcccaaatccatcccagcgcataaaacaatagaagaagcaaaatactgaaaacaacaaaagtagcgtcttgcatcccattcagaaccataataaaaagactcacaacgggcaaggcaagaaccaagccgcagacggtaaatacggtaacggctatttgggcgcacgcgccgtacatccacgaacctaatctcatataaacacccctatatagattccctatgtatatagtgaaaaagctcaggcaagtctctgcctgcctgcgtaaaaacctattttgccgcaaaacggaaaacataccgtcacaacggcgcatactgccgcaaaactcggtgtcaccgccgaaggaaacagcccagccggaaccagattgaacaaaaagacaaacataaaacatagattcggcaccattgaagcccataccgtccgctcagcaagctttttgccgccagccccgaactctttgccagcttgatagccgatttggaaccaatacagcacataaccgatcataatcagccatactgacacggaaatccctttccacagcgcgtcaactgcgggatgaatcctccacgcgtgcatcatcgtaatcatcgcccccatcacaaaaagagcgcagttgcagaacagataaaagagcataaaagtccgcgcgggcaccgccgaagctttttgaaaagcagagataatttcagacggagtccccacttcccgcagaataagctccatcgcttcgctttcggttttgcctttttccagatgaacacaaatggcatgatgaatatggctttcgatttcctttaataattcacggcttccggccttgccttccagcccttttctgatttcgtgcacataaaggtctttatccattctgcccgccccgcttcagcatccggtccatcagagcggagaacagattccattccttcgtccgttcggctagaatgttttttccttcatcggtgatccggtaatattttcggtcgggccctttggtctgcttttcccagtaagaagaaatatagctttggcgttcaagcttatgaagcgatgggtacagcgtgccttccttcatttgcagttcattcccgcttcttttctccatttctttcacaagttcatacccgtacatgggccgttcattcagcagcgtcagcaccagaatgaccgtgcttccctttacaagctccctgttgagcatttattttctcacccttacctagtaatcttatgtaggtattgtacgcacatcccccgcggctgtcaaatcattcctccaagccttccgtattgtgatcgggagaaaatctaactataatgagatataaaacactgatggaggccattgatatgtcaatgcacaaagcacttactattgccggttctgattccagcggcggcgcgggaatccaggccgatttaaaaacatttcaagaaaaaaacgtatacggaatgacggctttgaccgtgatcgtagcgatggacccggagaacagctgggatcatcaagtatttccgattgatgccgatacgattcgcgcacagctggcgacgattgttgacggaatcggcgtagacgccatgaaaacgggaatgctccctaccgtggagatcatcgagcttgcggcgaaaacgattaaagaaaaacagctgaagaatgtcgttattgatcctgtcatggtctgcaaaggagcgaacgaagtgctgtatccggagcatgccgaagcgcttcgcacccaattggcgccgctggcaaccgtcatcacgccaaacctgtttgaagcaagccagctgagcggtatggatgaattaaaaacggtggaagacatgaaagaagcggccaagaaaattcacgaactcggcgcgaaatatgtattgattacaggcggcggcaaattgaaacatgaaaaagcgatcgacgtgctgtatgacggagaaactgcggaagtattagaaagcgaaatgattgatacaccttacacgcacggagccggatgcacattctccgccgccgtgacggcagaactggccaaaggcgctgaagtgaaggaagccatctatgcggcaaaagaatttatcactgcggcaatcaaagaatccttcccgctgaaccaatacatcggaccgactaaacattcggcgatgcgtcttagcggaaaataaaataaatatccccctcatgatcgagggggattatttcatttttttcgcggatgaccgcaaaaacatctcaatcgattgcacaaacagcgcatattccttcatctgttcatatgtatgcctcagccgatcactccattcattgtgcggctcagccctcttgagcatgcgattcagctgaagcaatacttctttatattcttcccgtttatcttccacttgctctgcggctttgacaagtaaacatttcggcgtcatcttctgatttttcaaaactgagaaaacaactccttttattcctggaatcataggctttcgtttgaagaatagcacagatggcataggtttcacataagaaaaaagaacgattttctacaaaagtgtccaaattgaggcatttatttccgttttcccaaccgaagtgacggttacgtcatcatttcccgggaaaggaaaatatctggcgctgaatacctcttctccatcattcaaaaataattcgatggaggatgcatccagaaagagctggacggaatgcagctcgctgatggcgcagcttctcttttctttttcttctccgctgaaagcggtgcgctccagcacagccagcccctcttcctgatgaaatataaaccgggccgcgccccgaattgagatttcaaaaccggattcgcaagtaatgtcttccagcagcacttcagcccgggacgcatctttcaccgggaggcttacagacgagcaattcaattgaagacggcgcttttgttcatccgtgcggcgcgatttcatttccgggagcgggcgctgtatgattctgccgttggacagtgacagctgtctcggcatcgttaagcagtgaatccagtgatacgcatgtgtcggatgtttgtcctcatgctgatccggaacgcccatccacgcgaacagaatcctccgtcccttatcatcttccagcgtctgcgccgcataaaaatcaaatcctctgtcaagctccgtaaattcaccgtgcttaaattctggcggctctgtatgcagcctgccgaggaaatagcccgcctggtggctgttatgatattttatcccgtcggcttcaagcccctgcggacatacgagcagcacgtcggttccgtcaagggaaaacaggtcgggacattcccacatatagccgaatgacccgagaccgcccgagtccgcccccgcaatcgaaccgagaaacgtccaatccgtcaggttctctgatgtgaacaatacagcgcttccggtgagcttttctgtctgcgcgccgagcaccatgtaatacgctccgtctttcttccaaaccttcggatcacggaaatgagcggtatagccttttgggagacgcgcgacgattccttttttttcaaatacgatcccgtcttcggatacggcgaggcattgatacgtttcccgatttccttctccgtcacggacattgcctgtgtacatcaggcagagccgcccgtctttttcgatggcgcttccggaataacagccgtttttgtcataccactcacccggcgcaagcgcgatttcttcctctttccactcaacgaaatctttcgtcgtcacatgcgcccaaaatttcgcgccgtgccccgtatgaaatggctgccattgaaaaaacaagtgatatacgccgttccattggatgacgccgttcggatcatttaaaagcccgaccggcggcataacatgatagttctggcggtatggatctgacgcggctgtttcttgccgcttctttttcgcttcctcagcctgcaggcgcagctcttgatccggtgtcctcatttgacggcctccttttctttagctcccataatgtaagcggcaataaacgccgaaacagaggcgatgcccattccgatcagatagtttataagatttcctaaaccgagcggagccgtgatggcaatcatcggaattccggtcagaccgtaggcattggcggcgacaccggtcaccacgacataggcccctcccagcgctccgccgatcattcccgcgataaacggcttccggtaccttaggttcacaccgaaaataactggttcggttacgccgagaaaagcggaaaatgcggcaggcagagcgatttctttcattttcgcttttttcgtcaggaaaaatacagccagtcccgccgcgccctgagcgacattcgccatcgaccagataggaaggatgtagtttctgcccaaatcagcgatgaggccggcctcaatcgcatgaaagctgtgatgcacaccggtgagcacaataagcggataaagaccgccgaaaagcagtccggcaacaatgcccgcgtgatcatacacatatgtcagcgagacggtaatgcctgatccgatcgccctgccaagcggaccgattgcgataaaggtaataaatcctgtgacgatcaccgtgacaaacggcgtgaccaataagtcgaatgcgtgaggcaccatttttctcgtgcccttttccactttgctcataatgtaaacggctaacagtacggggatgaccgtcccttggtagccgagcagcgcaatgtcgaagccgaagagctgcataaaatcaggcgatgcatccgcaagcccccacggattcaaaagcgccggatggatcataatccccccgagcacggcaccgagataggcattacctccgaattccttagccgcactgaacccgatgaatacgggcaggaagataaacgccgcgcttgaaaacatgtctaaaagcttaaacagcgatgattgttcagacacccagtggaaagccttcatcataccgagcagccccattaaaagtccgcttgccacgatagccggaatgatgggaacgaatatgttagacagtgttttcgcaaatcttgcggccggattcagcttttttttcgccgcgtcctgatgtgtctcacgatcctcgcgccccaaatcggcttcttttgaaaaagcgtcatacactttattcacaaggccggtaccgaatataatctgatattgccccgagctgctgaaagccccttttactccttctgtctcttcaatatcggcctggctgatcttctgttcatcttgaatgacgagcctgagccgtgtggcgcaatgtgtcgcgctgatgatatttgatttccctccgatatgtttgataagctgttttgccgtttcttgataattcatgatgtatccccctttctaaaatcaaaaaagacctaaaattcgccaacgaaaaaggtcagcatgatccctttttcatgtacgcaaattttaggtcttgcctgcattaccagtcacaatcccgccgattcagttttttaatgcgctttcattttatttcatgatagcgctttcgtcaatatgttttcaaaaaaaaagtctgtttctcgaaacagacgcgttattccgggtttttttgcagacgctggacatgcagcgtaatatagccggcctcggattccggcagttccaaatcatattcattttttaaaaacgccgccagttcaagcgcacaccgataagcaaacggatactttttttggatgaaataaagcatctcctcgtccatggaatggagtgcttcatttgagtccaaccggctgaccgcataccgtaagtgcgtgacgaggcgctgataggaaatactgtcttcatccaccttctgttcgaaaaaggattcgatcttttcgatcatttctttgatcatggttgtatgcttcatcgccgaatacatgcttttggcatccgccttggcagtgtggatatgaagcgcgatataccccgcctcatcatcaggcaatgatataccgagggtttgtttcacgtgttcaaccgcccagcggccgatttcatattcttttttataaagcgccttaatttcatgaagcaatcggttgtgcacctgaaggccgttttgaatcctttcgatcgcaaaggataaatggtccgccagcgcaatgtggatgtgatcgttcaaaggcgccgcaagctctccctcagcatggctgatgatatcttcagccgcctctatatgctcttcgggaagcgtttctaacacttgtttgaacttttcattttcgtcgtgcacgacaaatattttttcaattttatgtttttgaatcacatcattttttctcttttgaaaagcgattccgggacccattacgatcttttcccgtccgtcttcttttattaacgccgcattgttatttaatactttgtctattctcaagaggttcgctcccgttcatatgtttagtgggattgtaccctctttttcatatgatgtaaaggtgccggacccgcgcgctcccgtttcggcaattctttgcggacaggcatccatcggtttttatccagcctgccgcgggccgatttcgtttcatcggtcaaatccgccgatcggactcggctcacaaacgaaaaagcaccagccgtccgcttcgctttcttatgataagccgcttggtttccgtacacggcggctaatggatatcttccgttacccggcgccatccagttcatcagaaagaccatccacacccgtaaagatactagcaaacgtttcattgcaaatcatccctccgcttctttttgacagacagcttgttcgcaggcctgtttttctctccgctttaacggaaaaggcggccgatccttctccgctaaaaactagcgggtctagcaaccctatgactctatgatagacgcggcagggcgaattgtttgtcacaatatgagtgaaaaaacaaactagttttcagaagttttgttgaaagctgatggaaatgacctgaaaaatggaaaagccgataaaaaagttatacacaccttatcccttggttaagcacagcttaaacacagggtatatccacatatccacaaactcgatctatattttgtataggaacattcgttcccaacaatatatatacacaattttattcagttatgcacaggattttgtgtataactccctccttattcacagaccaatttccataaatgagtcatatgtcacaaggattattttgaattttcaagaaatatatactagatttctaatttagataaagaaaaagggggaaacacgattgaaaaaaggaatcatccgttatctgcttccggcttttgtcttatcctttaccttatccacaagttcacaggctgcgccggcaacaaaaccgcaaactcctgatcttgagaaggctgaggtatttggtgacattgatatgaccaccggcaaacaaacgacagtcatcgtcgagctgaaggaaaagtcactggcggaagcaaaggaactcggcaaagcacagacaaaaagcaagctgaaaagcgaacgctcaaaagtgaaaaagaaagcgctcaaaaccattaaacacggaaaaatcaacagggaatatgagcaagtgttttccggcttctccatgaaactcccggcaaatgaaattccgaaactgctgagtgatcaggatgtcaaagcggtttatccgaacgtcacctatcataccgatcagctgaaagataaagacatcaccctatctaaggatgccgtgtctccgcagatggatgacagcgcgccttatataggggcaaatgacgcgtggaagctcggctatacggggaaaggcgtcaaggtggccattattgacaccggtgtcgaatataaacaccctgacttaaagaaaaatttcggacaatataaaggatacgattttgtggataacgattacgatcctgaagaaacgccgtccggtgatccgagaggcgcgtcgactgaccacggaacccatgtcgcgggcacggtagcggcaaacggaacgattaaaggcgtagcgccggatgctacactccttgcctaccgtgtgctcggtccgggcggaagcggaacaacggagaacgtcatcgccggtattgaacgcgccgtacaggacggagcggatgtcatgaacctttctctcggcaattctgtgaataacccagactgggcgacaagcacggcgcttgactgggcgatgtcagaaggcgtcacggccgttacatcaaacggaaacagcgggccgaacaattggaccgtcggctctccgggaacgtccagagaagctatctccgtcggagcgacacagctgccgctgaacgagtacgccgtctccttcggttcctattcctcagcgaaagtaatggggtacaacaaagaagatgacataaaagcactgaataaaaaagaaacagagctcatagaggcgggtatcggcgagcaaaaggattttgaaggcaaagatctgaaaggaaaagtcgcggtcgtcaaacggggcagcatcgcctttgtggataaagcagacaacgccaaaaaagcgggcgcgatcggtatggttgtgtataacaatgccccgggagaaattgaagccaacgtaccgggcatgtccgtgccgacggttaagctttcatcagaagacggcgaaaaactcgtcagccaattaaaagcgggcggcacaaaagcgacattccatttatccgtggctaaatcgctcactgaacaaatggcagacttttcgtcacgcggtccggttatggacacgtggatgattaaacctgacgtctccgctcccggcgtaaacatcgtcagcaccattccgacccatgatccggccgacccgtacggctacggatcgaagcagggaacgagcatggcttccccgcatgtagccggcgcagctgccgtcatcaagcaggccaaaccgaaatggagcccggaacaaataaaagccgctcttatgaacacggcggaaaccttaacggacgcggacggtgacgtatacccgcataatgcgcaaggcgccggaagcatcagaatcatgaaggcggtcaaagcagactcccttgtcgccccgggaagttattcttacggaacgtttatgaaagacaaaggcaatgaaacgaaaaaagaaacctttacgattgaaaaccaatcgtccatcagaaaatcatatcagctcgagtactctttcaacggcacgggcattaccgtttcgggcacagaccgggtcgtgatccccgctcatcaaaccggaaaggtcaatgcgaaagtaaaggtcaatgccaaaaaagtaaaggcaggcacctatgagggaaccgtcacagtgcgtgaaggcggaaaaacagtcgcaaaagtgccgacgctgctgattgtaaaagaaccggactatccgcgcgtaacgtcaatcgacgtacaggacggcacaacgcagggaacctaccaaattgaaacctatcttccggcgggagccgaagagcttgccttccttgtatatgacagtaatcttgactttgtcggccaagccggcatctacaaaaagcaggataaaggctatcaatatttcgactggaacggcaaagtcaatggtgacaccgcactgccggcaggagaatattatatgctggcctatgccgcgaacaaagggaaatcaagccaggtgctgactgaaaaaccttttatcattgaataaccgaacaaccctgctggagcatcagcagggtttctttctgactattcggcaaaagcttctcgaagcagacggtatgactgaagtttatcttcaaaatgatgagtaatggtcacagccattacttcttccgttccgtatgctttactgagagccagaatctgttccttcacttgctgcttcgttccgatgatcatccgattccgattatcggcaattcgtctttgttcatacggtgtatacgtattgccgcggacggtttcgtaagacggtacgccgtgaagcggaatcccctgttcacccgcaagcagcgtataatccatgacggccgcgagttcctccgctttctcttccgtgtccgcgcacagcacaaacaccgccacggctgtttttggttcttttcctaatacagaaggtttaaatctgcgcttatattgtgctgtcgtgctttctccgccttctccattaataaagtgggcaaacatatagcctgctcccatttctgcgctcagaagcgcgctttcccccgaagaaccgagaagccagacttccggcgccgtcttaataaggggtgatgcggtcagattcggaaaacggtgattgtcatcagctgcatcatgcaaatacatcgccagctcacgaagctgctgcggatattgatcagcgttacgcttcccgccgtcattcagcgcccatgatgcgatcggcattccgcccggcgctctccctaatccgagatcgattctgcccggcgtcaacccttcgagcacgcggaaattctccgccactttatatgcggtgtaatgcggaagcatcacaccgcctgatcctacccgaatgtcattcgttttcgccgcaatatggctgatcagcacttcagggcttgagcccgccaaccgctctgaaaaatgatgctctgacacccaaaacctcttatatccgagcttttccgcctcctgcgccaatcttactgtattccgcagtgcactttccgcagaacacccttctgatacaggagattgatccaatatacttaatgaaatcatcactgtcacctcatcaacatcgtaccactgctaagccgttttttctttctgtatgcttataagcatccctgatgataaacatttatataccttgttccattttgtcgaaatatgttacacgtgaaacataaaaaaacctctcccggtcaggagaggttttttcttaattcttttgaaaacctttatcttttacatattgatttaaataggttctcggtttttgtttcatgaactgcaggatttgatcagaccacgtttcaacccgcttgccgtttgtccgtttatcataataatcggaaatggtttcatcatattccttcatataactgcggaagttttcttcattcgtatcgtacgtgttttcatgatatacggcttgtttcggcaggcgcggcttttgaccggacggatgagcgggatgaccgactaccaagccgaacagcggcagcacatggtcaggtgtaccaagcacttctgtcacctgatcaagttcatttcgaatgcctccgatataacaaatgccgagtcccattgattccgcggcaacacttacgttttgtgcggcaagtgcggcatcaatgatgctgaccataaacatttccgtattctcaagaagctcggtaatgttttctcctttttcctcagcaagttttttatggcggtacaaatcagcgcaaaacacaaacaagtgcccgttattttcgacgtaaggctggtttccggccagtgccgccagcttccgctttttctccttatcggttacgccgatgatggagtaagcctgcacgtaactggacgttgacgccgcctgggcgcttttcactaatgtatctatctcttctgctgtcagaagctcgtcagtaaatgatcggatcgaccgatgattaagtatggtttcgatggtattgttcatatataaagcctccttctctatatatcatatccgaaagagtatcatgccaaaagcgaaatgctctaaacaaaaaaagacagcccgaaaaacgagccgtctcacattaagaattgaacaagtagcttttatatttcgtcagctgcacacttgcgttatatacgatcccgaagctgattaatgtagaaagcaccgagctccccccatagctgacaaacagcagcggaataccggtaaccggcataatgccgatattcatcccgatgttctggaaggtgtgaatcacgataagtgcagtaaatcctacgcaaaaaaacgcaccaaatcggttaaacgcatgcaagcggtcaatcagcaccacaagcctgtaaattaaaaagaaaaacatgacaaccgcaatggcgcagcctaaaaatccaaaactttcacccaaaatcgcaaagataaagtcggtctgtccctcaggtacgtacactttcagattatgaacgccgtttccggtaatgccgcccgatccgatcgccataacggcctgatccacctgccagcttttatcgctctcggcctgagtcgttgccgcactggagtcagacatccacgatgtaatccggttaatttgataatccgcaataccgatcgaattcgccacatggggaaattcaattacaagcactaagaataggccaagcacaagcgcggccgaaccgccgatgatggtgatcagcttccagtttacacctgacataaacaccatcaccataacgataaacagacagatcgcacccgttccggcatcctgcaaaacgatcatcccaattggaataaccgtccatgccgcaattttcaaaagcagattgacatcttcccgaagtgatctttgatctttcgggcccgccttcgatataatggacgcgaccatcatcatgattcctattttcgtaaactcagatggttgaagagtgaagctgccgattttaaaccagctcttcgctccgtttttgatcggtgcgatggattccggcgccacacgcagaaggagcagtgacagcacgccggcaattaatacgtacagactcagtttttcaagctgctctaaatcaaagtacatgatactgaccatgagaccggctccgatgacataaaagacgatctgtctcatccaggcatcacttccgtactgcccgaactgtccggccgcataaatcgccgcaacactaattattaaaaacacaccaaatataaaaatcaaatccccctgataatagggattttgctgtttcttatatcgactcattctatcccgccttacattttcatcggaagtcactattgtttattatacatgaacaccgttcaagaaaacatgatgaggttgcttcctttttattttttatggtttggggactacacgacatatgacgtgtcagaaaaggaaatgtttcggtcatgatgaaacttttccgataaaaaaccccttctcgtcagaaaaggggtttcagtctatgtttaacgtcataaacaagctgttcgggtcctctttataatgtgcaaacggatcacaatattgaaacccggctttttcatacaggcgtctggcggggagaaaagcctccatagaaccggtttctaagctgatccgctgatagccccgccgccttgcttcttcaagcatatggcggaggatccggttggctgcgccttttctgacatgatgcggagccgttttcattgatttgatctcaccgtgccggctgtttagctccattaaggcgccgcagccgagcaggacgccgttttccctcgcactccaaaacgtaacgtcaggctgacgcagccggtccgcattgagcgcgtgtatactttccgggggagaatgcatggtcatgctcttcagatgctcctgcaaaagcgcaatgacgtccggcgctgtgacatcgtcttttgttatgtccacttcaaaaccacccttgctgtgcatgttttctttgaacatagcaaaggttcacagcctgcgccattcccttgtccggaaatgtgacagggtatttgacctttccggtttcttgtacctatccaaaaatgaggcaatagttgcaatacatttctcgaaaaagcggtatcaaaaattggaaaacatggtataataattgtaacaaaatgttcaaaaaacgaccacaaaacagacacattttattctctgtatttcattttggaaacgctcccataaaatgaaaggagacatgtaagatggacatgttttttgcttatttactggtcgcaagcgcaacacccctctttatctggctggataacaaaaaagtcgctctttcggccataccgccaattattctcatgtgggttttcttctacttttacgcaaccagcagcctgtcccctctcggccacacactcatgatcatcctgtttgccgtcaacgtcatcgttgcccatatcgccgcctttatcatttacggccttccgcgcctgcgccggagaagaagccaataaaggcacaaaaaaccctcttcgcctgaacgaagagggtttctttttattcctgatgttcggaatgttgcttcgcaccgccaggagggtttccatccatatggtcaccgtgatggtagtgcgccgcaaagatccagatggaaccaaggatgataacaatcgctccgaaaaatccgaagagcgtgtttccgacttgaatcccgccgttttcgctttctgtcatgtgcatgaacatgagaagctgaagaccggcttggataaatgcgaatccgaaaatgatccacagttttgctgatgggcttaattccgtatataccgcaacccaaagggccagcagggtcagaataatagacaacgcaaaacctacgatatgcttccacggaaagtggctgtgttcagcagatttgtttgccatattatagtccccccaatccgatgagatagacgcctgtaaagatgaagatccaaacaacgtctaagaagtgccagtataaacttgagataaagatttttgaagacgtctgcggcgttaatccgcgtttcttcaattgcagtaagatgccggcaatccagaagataccgatcgttacgtgcgttccgtgcgttcccagaaggacgaagaatccagaccagaaagcacttgtaccgagagatgctccttcatgtacatagtggatgaactcgttaagctcacatccgacgaagcccgcaccgagaagaagcgtaatgatcgtccaaatgacgacgccttttaaacttccgcgacgcatttcatgaacagcgatcccgcaggtgaaactgctgatcagaagcaggaatgtcatgatcatgacaagcttcacttcaaataattcagccggtaagactcctcctgctgttcttctttgaagaacgaagaaggttgcaaatagtgttgagaacaacacaatctctgcccctaaaaagatccaaaacccgagaatattgagtctgccggtttcagattgatattccataggcgcgttagaattgccgtgttctgcatgttccataaatcacgcctcctttattcggaaatctttctttccgtctcttttatttcttcaacaggtatatagtagccattgtcatattcaaatgaacgaagcaccatgcaaagcagaatgccgatcaagccgacaatgcccatccagaaccattcaaacacaagcccgaagcctgcaataccgaacgccactgacataataagcggtcttccggagttgtgcggcatatggattttcttgaacttgctttccggatgaatatccgttttgtcttctttcaattgcaggtacgcatcttgagatttcacttctggaagcaccgcaaagttgtaatgcggcggaatcgcagatgaagtcgcccactcaagcgtacgtcccacgccccatgaatctccgctgatctcgcgagtagagtagcggaagctgtagtagatgttgtagcaaaggattaagaatccgacacccatcatgaaggctccgacagttgaaataaagttcaatgcagtccatccgtcattcggtccgtaagtgtaaatacggcgaggcataccttgcagccccaagaagtattgagggaagaaacatacattaaatccgatcataaagatccagaagaaccattttccgattctttcgttcagcttgtggccgaacattttcggataccagaaaataaatcctgcgaaacatgcaaataccgtacccgcgatcagcacatagtggaagtgagatacgaggaagtacgtattatggtattgataatccgctgcagccatcgcaagcataacccctgttaccccgccgacaacgaagttcgggatgaacgcaagcgcccacagcatcggtgttgtaaaactgatccggcctttatacatcgtaaagagccagttaaagattttaaccccggtcggaaccgaaatcgccatcgttgtaatcgagaagaaagagttaacggacgcactgttccccattgtgaagaagtggtgagtccatacaaggaaactcaggacggaaatggcgataattgagccgaccatcgctttgtaaccgaataactgctttcttgcaaacgctgaaataatttcagagaaaataccgaatgccggtaagataacgatatatacttcagggtgtccccaaatccagaacaagttagcccaaagcatcggcataccgccggcttccagcgtgaaaaagtgggcgccgaacaaacggtcaaatgataacagcgccaatgccactgtcaaaacagggaaggcgaatacgataataaccattgtaatcagcgtcgtccatgtgaacatcggcatacgcatcagcgtcatgccttttgtacgcattttcaggatcgtcaccataaagttgatacccgtcatcagcgtaccgataccggcaatctgaagaccgagcaggtagaagttctcaccaggcccgggactcatgtcgttgcttgccagcggcatgtaactcgtccatcctgcgttcggagaacctccgataacgaaagaaatattgaaaagcatcgcacctacgaagaacgtccagaaactcaggttgttcaagtaagggaatgctacgtcgcgcgcaccgatctgcaaaggtacgacaacgttgatcagaccgattaaaaacggcatcgccatgaagataatcatgatcgtaccgtgagtcgtaaagatctcattatagtggtttgagtctaaaaaactgttattaggaagcgctaactgggcgcgcatcatcaagccgtcgaccccgccgcggaacagcatgataacagcagagataatgtacatgattccaagtttcttatggtctacagacgtcagccattcagaccagagccatttccactttttgaagtatgtgagtacaacgatgatagcgatagtggaaagcgcaatggaaacttgtgcgcccagaattaatgggtcacctgttacaaaaaattcatcccatctcaatttcattcgggcttcctcctttcttgttcaatttcaatcttgtttatcgtcggatactttaaattcgtttttctttacatcttcccacgggtctgttttagagtgcggtgatacggctttgtagccaaggcgtttgcgcgcctccatcgcatattcggcatcttggccgtggtcaacgtattttaagtgtgtagaagagaacgttaattttccgacattctccggaagcatcagttcgtcatacttctctttcgtcagctttggagaatcgctttgggcttttttcacccagctgttaaagtctttttgcgtaacagcttttacgttgaatttctggtcggcaaagtgttcaccggtgaagttcgcgttgcggccttcatatgttcccactttgtcagcctgtaagtattgatccatcagcattcccgccatcgcgtatttttgtcccccaagctgaggaatccatagcgatgccattgaatctgctgaagaaattttaaataaaaccggacggtctacaggaatgttcaggtagttaaccgtctcaatatcctgctcagggtagctgaatacccatttccagtctaccgaagtagcataaacaacaagaggctctttatcctttgtcgcttcaggcgctttttctaacgaatatatcgtctgtacggtaggcacagaaagtgcaataacaattaaaattgggatcactgtccagactacttctaagaacgtgttgccgtgcatctcgggcttgtaatttccgctgtctttgcctttgcggtcgcggtatttcactaaaatgattgtaaatagtacgaatacgacgccgacaatgaacagcataaatccgattgacaagagaatcagatctttctgctggtctgctacaggtcctttcggatctaaaacggaaatgtcgctgcatccgcccagtacgaaaacaacagccaacatcgctaataaaagtaacggtttaaatgctctgaacaagaagatcaccatccttcctattgatgtagtgaatctgaaatgtactttctcaaaatcttttctctatctaccttgttatgctatcaaaatctgcccttattagctttatttttttctaaagttcatctttttttcgacctaatgtcacaaaatcgtcaaaaaatgcatgaactttttccacttgcgtaaatcaaacataaaaagttttagatcatttagcatatatagagaaaaaagatagcgagaacgaataataccaaataaaggtttaccataataaaaatcgctggtcaacaaaaagtttcattttgttaaacattctacaaaagaattattttttcctttgctcacaccttttcacacggtttccattttaacgcaacgcattgtgaaaaaaaagaccggaacgcgccttgatatgttcattataaaaaacgcattcatatgtttaatatggacaaaacgaaggaaacatataggcataaataataaaaaataggaagtgatatttatgggttttatcgtatctctgattgtcgctattattatcggctggatcggaagtttatttgtaaaaggcagtatgcccgggggaatcatcgggtcaatgatcgccggtctgatcggcgcatggatcgggcacggactgctcggcacatggggtcctcaccttgccggctttgccatcattccggcaatcatcggagctgcgatcgtggtattcttattcagcctgatcgccagaagcagaggataaaaaaaagcctcgtcccttatgggatggggcttttttccggtagagcgcccaaatggcggataaaccgccggaaagccgctctgccttcttctgtctgtttaaagacgccggcatgctccagtatccgcgcaaaggcatggccgatttcctctttcagaatctgttccgcattttctttcgttaccttccgcttatgcagcacactgagcgcccaatctttatgctttgccgcagaagggtctgccgttaagaccgcctccgggtccggtgagcacagcgcttcagccgtgtatttcatttcttgttcaaggcggcccggcagaatcgcaagccccattacctcaatcagtccgatattttcttttttcaggtgatgaacttcctgatggggatgaaaaattcccagcggatgctcatcagaggtgcggttatttctgaggacgagatctaattcgaataaaccgtttctccgcctggcaatcggcgtaattgtattgtgcggtgtttctcctgaacaggcgaggagatcagccgcctcatcggaataaccgcgccatgcccgcaggatggcatccgccgcgccggaaagctcagacgcgctctcgctttgcaggcggatgaccgacatcggccacttcacaattcccagcaccgttttcggatagtcaggcagcctgtaccggctttctgtctccgccagcgccatcgggaattcataatggcccccctgaaaatggtcgtggcttaaaatactgccgccgacgatcggcagatcagcattggaaccgagaaaataatgaggatactggctgacaaacgacagcagccggtcaaacgtttttttgctgatcttcatcggttcgtgccggtctttcaaaacgatgcaatgctcccggtaatacacatacggagaaaattgcagaaaccactgctcatcgccgagaatgaccggaatgacacgaaggttttgacgcgccgggtgatccggtctcccctcgtacccgacattttctttacaaagaacacatcccggataatcggattgaggctgctctttggcagcggcaattgctttcggatctttttccggttttgaaaggttgatcgtgatgtccagctttccgtaagccgtctcagccgtccacccgacattccgctgtattctgtccgaacggatataatacacatcctctgaaaatcggtaaaacgcctttgtcgcctgctccggcccgtgcaccgcctttgtttcttcaaaacgacgcacaatctcggacggctgcggggcaaagcagcccatgatcttcgcgctcagcaggtcgcgataggtgtctgtatcggctgcaatccggcccgtttctgccgcccattcataaatcggggccaatatgtccggcaatgatgccgccgattcattttctttctgttctgaagcctccggatgggtaatatgcaaagtttcatataaacggtttcttgtatattcaatatcaagaaatgaaatcagctctttttgcaatccgtaccggattaaacgttccacgtgccgctcaattgccatcgtcatccccctttagttctctcgctccgatatccgccgtgtaaaagtcagtttctccctgtcttctcctcatagcggcccccgttagctctccgatgagattcactctgccgggcgcaaagaaaaagcgcaggtctcgggctccccgaatacatcagcaaacgctttctttattttgcgcttcaaacgcatccccctccaccattacactttccccccgggacgcggaaagaaacggttatgacacgccttcttctttcgcttttctgaagacaatccacttgctggccgcatagttgacgactacaataatgacgttatcggcgattttcgccaatgtttcgttcatatgaaattgactgaccagaagaatcatcatggcgagatcgatggcgagagacagtacccgcacgctgaaaaaggccgttaattctttcatcagactccgcatccccgcggtcttttgctgaaagacataccgtttattcgtaacataagcaaatagaacggacagaatccaagcggcgacagtcgccgccttgtaatccatctcaaatgccgacgtcagaatgtaaaaactgacgatattcacgatggtcgtgaatatccccataatgatatacatcataatttctctgtagcgcatggcagttcctcgctttctgaaagacttttctaaaccttttgtcaaatcaagaagaacgttaccctgattttctgccgctgacaaaaacatagagcgcgtcaaacatgctgcggaaagtaaccggccttcccagcacattagattgcttaatcatcccgtcgatgagcgcgcacatcatgttagcggtatgctcggtatctatatggtcttctattaaatttctcgatttgagccaatttatgtacatggtgctttcttctatccataacttatacaggcggatataagcttcatattcactgacgactttgtaagtaggcatatgaacggcaaaagacacaacattccaggcaggcttgctgtttacaaaccgcatcaacaggctggccgcgctggccgcggcttcacaaagcgtcaacggccgctctgtttgcttttctaattcgtcgagatagccagtgatgatcctttttttaatctgacgcctctctaacaaatgcttcagaaaatcttccttgctttcaaaatgaacgtaaaacgcccctttgctgaaacccgccgctttactgatgtcatcgattgagactgaatcgtaagctctttcaatcaggagatgaaggcctgcgtcaataaaactttcaaatgtttcttctctcttaatttgaaatttgttttttttcattttttaccccagctgtttgatcattcactttatcttacaccgaatcattcttttgcggtattttttatgcaaaaagaatatgctaatcgacgttttgagggtaaatgttaataggtcatatggtttatttttatttgcatactatccagtcagtatttatttgtttattattatatgtaagaattcttgaaggattttggttatttcagtcattttcttagggaataggtaggtgaattcatcttcaatttgggattaccggccaactatgtgtgatatttgttatacattggctgctgtagctgggcaaatcaatttttcaattggaggttcttatgaaaactcatgtaatgaaagatatagatcaagattggcaattgttaattcaagaggctagaatcatgggtttgcacattgacgatgtgaggcgcttcttaaatactgaaaaagcggtgaagaaaaaaacaccaatgaaaaacaccatccgccagcggtaagattacaggcggatccttttactatatgacctgccacagtccgcccgcacccgagttttcaaaggaacacccgcaataagaggggaatcagagaacaaaccgtataccggacaaccattcccgtccgcattccgcaattgaacagccaaacatggtgatatgagatccccccgctgcatatcttgtgtattatgcccatttatgaggtgatacacagatggatacgaatccctattatgatgaaaaacaacagaactactacgaaggcctgaatccttatttattgaacaaaatagacgaaaactggcggacagtgcttgatgtcggctgcggcacgggcaatttaggagcggcgatcgaagaccgcggaataacggtttacggcattgaagcgtatcccgaagccgcaaaaaaggcggaaagcaaattgagccacgtgctttgcggcgacattgaatccgccattcttccgtacgaatcagagcaattcgactgcatgctgttcggagacgttcttgagcatcttatcgacccgtggacagtgctgaaaaagcttcgtccttatgtaaaaaaagacggcacggtgcttgcatgcataccgaatgtcggccacatctcagtcgtgctggagcttttagccggcaaatggacttacagtgacgccggattaatggatcagacccacctgcgtttttttacccgggaagagactctttcattatttaaagccgccggctatgaggtcaaacgcattgaggcgatccgcgttgatcacccttcttaccacaaagccatcgcatcattgcacgaagtatgcgtacagcttggcataaggcatgactttatgacagaagcatcggcctatcaatatgtgattgaggccgagaggagcatgtaatggattcacattcatttctgtttgtcgtctgtgtgaatgatgagtcgctgtactcccggtgcaagagccatatcatgcagcttaccgtccccccttcatactccgttgatatcatgccgatatacgattcagcaagcatggcctcgtcctacaacaaagcgctgaaacacccctccaaatataaaatttatctgcatcaggatacttttatcattcatcagcatttccttcatgacatgcttcatatctttcaatctcatcaggagctcggccttctcggtgtcgccggctgcaaaaccctgccgccgaacggcatttggtgggaaagcggacagcggatgggaaaagtgattgaataccgggggaatgcttatcacccgctggattttgagcacggtgatgaagacggcctgtttacgcccgctgacgccattgacggcttgttaatggcggctcaatatgacgtggagtggcgggaggatttgtttcgcggctttcatttttacgacacatcacagtcgctcgaatttcaaaaacacggctatcaagtcggcgtcgcctgccagaaagacccttggtgccttcatttttgcggcgactcctttgacgccgcggcatatgaagcggacagacaaacatttgtcaaacactatatggcaaagccctctcgctgatcgagagggcttttttcgggttaacgtttattcagttcccgctcaatgatttgttcaaagatttcctttcccgccgcgccagggattctctcatcgccgatgataaacgtcggcactgccgtaatgccggcttcctcataagcatggcggagcgcttcccgctgtacgtccttgtacgctcttgtctcaagcgcctctttgaaggcagcgccgtcaagtccggcttcttccgcaagctttgtcagcacgccaacgtcaccgatattttgttcttcctgaaagaacgcctgaaaaacgcgtgtatggtattcgcttcctttcccgtgttcctttgcgaaatgaaagccttcaaatgccaaatccgtgtatggatgcggtgacacgcgggggaacgtgatttcaacgcctaacgactgcgccatcggctcaatggagtttttccacatctgccgcttggcgggatcattcaccggatcaagtttcggcgaggggctcggacgcaattcaaacggcatccattccacctgtacgtccttgtccttgattgcttcttcaaacgccgctttgccgacatagcaaaacggacatacataatcagaatatactttaatctgcagtgtcattgtaagtctcctttccttatcattttaagttgtaacttttatagttacaagtgtttttttaaaaaaacaccctccatatggaaggtgtcacgattccagcagcctttgggcgatatattctccttttttacagccgccgggacaggcgaataaggaagagccgatcgtttgtgtgtattcattcagcgcatcctttgccgccaaagccttcagcatcgggacaaattggcggtccgggtctttttgaaagcagataaacaacaggcctgcgtcaacatagcccgtcttcggatcaattccgtccgtataggaaaatgcccggcgcagaatctgtctgccggttgattttgccacgctgacatgcgagtcggcgggaatttgattcagcttcacgggatcggtttcctttttttgtccgaaaggcgcgcccgagcttttcacccgcccgaacgtgtcctcttgttccttcaaggatgaacggtcccatatatctaaaaacatcttaattttcctaaacgccatgtacgtgccgcccgtcatccagtccggctctcctgattgaacccaaacgatcgaattcatcaggttttcatccttcgtgctttggttgccggtaccgtctttgaatccgaagaggttgcgcggtgtttctccgttttttccgccgcttaagaaacctttattgagaaagcggacttcacacacacccgatgcctgtttcatcaggttgcgcaccgcgtgaaacgccgtttgttcattatccgcgcagacctgtatgacgatatcaccgccgccttgtttcttatcgagcttgtcgttaggcatcggcggaatatcggcgaggtgcttcggttttttatccttcagtccgaagcggtccttcccgtctttctcgaaaaacccggggccgaagccgaaggtaacggtcaaattcgccggtgccagatcctgcgactccccggtatcctgcggaggcatatatttatttttctgttcgcctgacgggacggcgcctgaagtcagcagctgcgtcaggcttgtccattgtttgaaaagggagatgacatcggctttgtcgcttgacatgacatcaagcgccgcaaaatacacatacgtctgatgcgccgttgtgattcctgcttggtgctttccgtaaaaaggaacgatttgatcacgatcacgtttttcatcattcttctttgaagcggtggccgccggtttgaagagcggcgcgagtcctccgaggccgctcgctccgacagcgacggctgcgcccgcgacggcgccccacttcaggacatcccgtctgtggatctgtttttccttgttatgttcatcgctcatgctgtgtcttaactccttttaaagcacatcggcaatcttcgacatggtttcagaaagggccgtcagcttcgtgcttatctctctgatttgatctgtacttaatgtatcacaagacgtatacattgatcgtacgttttgtatttcgacatcaaaacttcaaattcgctgaattccgcattaagtttttccgtgacctcgaaatggtctctcactgcgcgctattcactgttttatagagggcttttgagcctgcggtgattggttcaggcgtcactttgagagaagcgatagagccgtcaaacgtttcggtcgatattgcaagcttgattgctctgttcttgacatacggcttatattcccccagtccgtcacgcctttttgcgcacacagaaaaagggccgccctatcgggacagccctgctttggagcgccgaatttcctctgaaaacttccgcgccgccgcttttggatcttcggcttggctgatggcgctgatcatgctgacgccgtctgcccccgcttcaatgacgggcgccgcgttgtcagccgtaatgccgccgattcctacaatcggaatggtgatgccctgacgccttacctcttcaatcaatgtgacgccctgcacggcttcagcatctttttttgtttcggtcggatagaccgggcccattccgacgtaatcggccccggcggcttccgcccgcttcacctcggagacgttatgtgctgacacaccgagaatcatatcgccgattgccgctctcgtttcttcggcgtctgcgtcatcctgtccgatatgcactccgtccgcctcaaggcgcaaggccaattcgacatcatcattaatgatgaaaggaatcccggcctgcctgcagacatcctgcacccgcttcgcgaacaggacacgttcatcccctgttaaagcaccgctccccttttcccgaaattgaaaaagcgtagcgccgccctcaattgcttttttcaccacggaaaccgggtctgcgcttgtattgtttgatcccataataaaataaaccgataacatattcttcatcatttcccgagaaatacgcgtcatttttctgtcaccctttcaattgcggcaagctcagccgcttcttgttctgagatgcttgccagcttgtttaaaagctcaatctggaagctgcccggccccttatgggaggtgtccaaagcggcaagctgagcggcgcttccgtatacagaaacggctgaaacggccgcttgcagaacgtcctgccctgctgcgcagaaggctccgattacagacgtcagcaggcatcccgcccccgtcaccttcgtcagcagtttatcaccgttttgtacggcgtatgtgtcggtgccgtcggagatgacgtcggtttttccggtaatcgcaatgaccgtcttcagcccgcttgcagccgtcttagcgagctgaaccacatctcctccggcttcccccgcatccacgccttttatctcccaatcaggggcgccggcaatattggcaatttccgcggcatttccgcgaataacggacaagcggacctcctgtatgatcttgcgggctgatgccgtccgaaacggcgtggcgccggcgcctaccggatcaaaaatgaccggaacaccgttttcattggctgattttccggctgcgatcatagcttcaaccgatgccgagctgagggtgcctatgttcaggacgagcgctccggcgattttcgccatgtcggcggcctcctcaattgcataagccataacgggcgatgcgccgagcgcgagcagtccgttagcggtgaagttcgtgacgacattattggtgatactgtgaacgagcgggttttgatcccgcactttactcaagtgttgagctgcggtttgtgcgtccatgcttaatcatccttttttctctttttcggattccataaatacgatttcgtatgctccagccaggctctggcggcaaaggacatatagcggtccttccgccaaatgatggctaaatgccacggaatgaccggatgaacgagcggaatggttctgactttgtcaggatcaagaccgcggcagattctttccggcagcaggccgataccgagattggcggataccatttcgctgataaagtcccactgtgacgtttcataaatgacatgcggcctgaatccggctttcacgcattccgtcataattcgattatgaaggacaaaatcctccctgaaaaatatgaacggctcttctttcaattcatgaagactgcattctttctcgtcagcgagccgatgtgacggatggacgacaagcataagggtttccttgacgattgtgaaggtatgaaaaatctcttcattcgcgggaagcacgacgaccccgatatcaagcgagccgtcctccaccccttgctgcactttaatagagccgtcctcaacaagctgaaacgtcacatcggggtatgtgacgcggaagtcaccgagcactctcgggaaaaagccggacccgatcatcggcggaagaccgatgcggacgtgccctttcttcacttccataatatcgttcagctctgacgtcaggttttggaatgactttgtgatttcctgcgcctgcacatacatgctctgcccggcgtcagtcagttcaacttgccggccattgcggtaaaacagtttaatgccgagctccgtctcaaggtttttaatcatttttgagattgtcggctgtgaaacatacagagactgtgaagccttcgtaaagcttttcaaacgggccacttccaagaaatacgttaagtgccggatatccattacatttcatcctttctatagacaaaaggaatacacattattctttatatgtattttacctatagcaaaaccttctgtacaatataaatataagggaggcatcattatgaaaaaattgctgcttaccgttattcaaatcgctctgctgtttatatttgcgcgtctgatcaattgggtcacggcggctcttcatataaatattcccggcagtataatcgggattgtgattcttttcacattattgcatttcaagattatcaaacttgaatggattgagcttggcgcagcatggctcctcggtgagctgctgctgtttttcatcccgtctgccgtcggagtgattgaatacggagatattatgtctaaattcggcgtaagcattttacttgtcgtcgtcatcagcacatttgtcgtgatggtttcaacaggtacgcttacacagctgatagcaaaaagaaaggagaaaaaacaaacgtgttcatcggaatcataagtttattcttaactgtcttagtgtatttgggcgcgaaaaaactctacattcgttttccgcgggtgtatacgtcgccgcttctgattacgcccgctgttttggtcgtactgctgcttcttgtcaatgtcccgtatcagacatacaatctcggcggcggactgctgaccgatatgcttcagccggcaacagtggcgttcgccatcccgctttataaatatttcccgattttaaagaaatacgccgtggaaattattttgaacgtagcggtcggttcatgtatcgccattctgtcaacagcctttatcgcaaaatggttcaatctcggcagcagcttagtcgacagtctcgtgccgcgatccgtgacgacgccgattgccatgaacgtttcagaaatgatcggcgggatgccggccgttacagcggttttcgtcattttaacggctttattgggaacgatcatcgggccgatggtcatccgctatttccgcattgataacgaaattgcccggggcgtgctgctcggaactagcgcgcacggagcgggaacatctaaagcatttgagctcagctccgtatcaggaacgatctcaagcgtgtccatgattctcgccgcgattatgacactgtgcgcggccccgattttgctttcgtttatgtcataaaagactgctccttacagagcggtctttttttagttgccatgaagaattgatttgtctgtccttcataaaaagacgaaaacacgatatgataagacatgaagtgaatagactgaagaacggatgtgtcatatgaacggccagcagcgaagcagcatcagaaaaggacttgaagtcgatatcgtcctgaaagccgatcagcgttcaggaaagctgacaagaggaatcgtgaaggatattttgacgaactcaagcttccacccgcgcggcattaaggtccgccttgaagacgggcgaatcggccgggtgcagcacattattgaatagaaaaaagccggagcttcacgcccggctttttttctttaatttcagcaatgaaatcctcatatgttctccctttatatacaaaaaatttttaaccaactattgactcttacgttgcgtaatactttagagtagccattaaggaggcggcaaacgtaatgggtatgaaagtaaaagaagtagctgacctgattggagtaagcatacgcactctccatcattacgatcaaattggattattgactcctcaggaaacgaccgattccggttatcggctttattctgaagagaatcttgaacagctgcagcagatactatttttcaaggagctcgatttctccttaaaagagattaaagaaatcattactaatccttcatttaaccgaagggaagcattcattttacaaaagaaaatgttgattgagaaacggaatagagtcaataagatgattgaaaccatcgataaatcaatcaaacatatgatgggagagatttgcatgacgaacaaagagcggtttgagggaattaactttaatgataatctttatgagcaagaagcccgcaaacggtggggtgatcaacctgtcgataaggtaaatattagattgaaaaacatgactgatggtgagcaaaaagatttatctgataagtggactgcaatgttcaataaatttgcactccttattaaccaatctcccgattccccagacgtacaaacagctatcaaagagtggtttgattttctcaatgaaaattttggtgaatattcttttgatgccttttacggattaggtcaactctatattgaagatgaacgcttcactaagaacatcgaccggtatggtgaagggttggcgaagctcatgagtgatgccattacaatttatatagatactcaaaaaaagggtggtgcccattaaaatcattatcgaggatacaattgggcggagggattagtgaggccactttactcggcacagatgagatactaagtaatagcggtttttttctttaaacagtaagatatgaagattattttgtcccgtattaaagcgatggaagagggttttcttttccccctctttccacgctataaatgatcatcctattttttccgcaagaaaacaaccttcaaatagttcccttctttaaacgccggaatcgttttgaaatcttccggaagcgtgtattcttccaaaatgtcgtaacgctcatttgtttctttaaaggcggtctctataaaacctttaaatttcttcatattgaaggcgctgctgtttgtcgaagcgacgatgatgccgttttttgcggtgatggcgatcgtttccttcagcaggtttttataatctttcgccgcgctgaacgtccgtttttttgtgcgggcgaaagaaggcggatcaaggatgatgaggtcaaacgccagcccttttttctccgcatagccgaagtatttgaaaacatccatgaccttaatgtcatgcgcctcataatcaattccgttggcgctgaactgttcaatcgtttttgcgagactgcggttggcgacatcgacgctggtcgttttctcagctccgccaagcgccgccgccacggaaaatgcccccgtataagagaacgtattcagcacccgtctgccgtttgcatacttgtcccgaatcgctttgcgtacatgacgctggtctaagaaaatgcccgtcatcgccccatcgtttaaatccaccgcgtaccgtatgccgttttcttgaacaatgaccggaaaatctcctctttcgcctttgacaaaatcgtcgtcttccacgtattgcccggcagtatcgaatcgtttcttttcatagatcgctttataagaaagctccagtccgtcaatcgcctcaatcatgctgtccttataagcgtaaattcctttactgtaccattgaatcagcagataaccgtcataaaagtcaatcgtgacgccgccgatgccgtcgccctcaccgttgaaaagccggaacgccgtcgtatcgggcgcgttaaacagatgggctcttgcttcagccgcttttttcagcttgtccagaaagaaacgtccgtcgatccgttcatctctcgcgcgggacagcacccagccgactcctttattctgcaaaccgtaatagccttttccgataaactcgcccttctcggatgtcacatcaaaaagatcgccctctgttaaatgagccgagcttccggacagagcgtctttttcaatcagggggaatccttttttcagctttccggcaaatgtatctttcactgtaagtagcttcattgtgcattcctctttcgttttgctttctcttatcgtaccataaaacatgatcaacaccgcattgtcccgaaaaattcaaaacagggggaaaaccatgacagccaaaagaatcgaccatacaggcattatggtcaaagatattgaaacatccatcgccttttaccaagacgttctcggtatgcagttaaaggatcgtatcactcatacgaacggcattattgaacttgcctttctcggctttcaagaagggccggagacagaaattgagctgatccagggctacagcagcgagcttcccgcagaaggaaaagtgcaccatgtcgctttattgactgaagatatcgcggcggagttcacgcatgcgaagcgtcagggcgccgtattcattgatgaagaaatcacgacgcttccgaacggataccgctacttttacattgaaggacctgacggcgaatggatcgaatttttccagcgttaaaaaaacgggcgaaagcgcccgttttttttatgtttcttctgtgacgttttgttccgccgcccgttcctctctccatttttgaagatcccaaattcggaaaaacggataataaatgataaatgtaatcaggagattgatcagctgcatgaccgaaccggagattttcccgcccgtcgccaaataaccggaaatcagcggcggcatcgtccacggcacggcgattcccgccggttttgccaccatccccgtgctcatcccgatgtacgtcgccgtaatggtcaagagcggcgcgatgataaagggcacgattaacagcggattcatgacgagcggcatcccgaaaataatcggttcgttaatgttaaaaatcgcgggcccgatgccgagacggccgagctgtttcatctgtttgcttctggagcgcacaagcatggtcagcacaagggcaagcgtcgctccgcttccgccgacattaatccatatttgaaagaactgtgtcgtaaaaatgctcggcagcgcttctcccgcctgaaaagccaaacggttggcgtccatcgccccgtaccagatcggcgacatgacgccgccgattatggacgcgccgtgtatgccgcacgaccaaagcagcatttgcacgaattcggcgataagacttccgccgagactcccgcccaaaatagacagcggggtgcccagcagatcgcctacgacattgtggagacttttaaaaggagttatttcaataaacagacgggccagccatacaagcgtaataataatgaaaccggggatgagcgcaacgaacgatttgctgaccgcaggcggcactccgtcaggcatcttaatgacgatatttctttgtataataaaccggtacacttccgtagacagcattgcaatgatcatcgcgacaaacagacctttgcttccgagcagcgaaatcggtatgccgcctcccaccataatctctgttgacgagccgtcagggataaacggaatctgatacggcgtcgccaataaaaaggcggcaagggcaatggctcccgacgacagggcatccacctcatagctttccgcaagccggtaagcaatcccaaaggcggcgacaagcgccataatgtcaaaggacgcattcacgggatacccgagtttttcaacccaattttcaccgaaaagaccagccataaaatcggcataaccgggaatcggaagactcgtcagaatcagaaaaaccgatccgatgatgataagcggcatagtcaaaataatgccgtcccgcaaagctcttaagtgcctttggccggcgacttttccggcgacaggcatgattttttcttccatgacccgattgaacgtactcatttatcaaaaaccccctttttgagttcattgcgcagatgtcttaaagcattttctccatcatattttggaaacgcttacatttgcatacagaaattttccttatccctcaggaaaaaaagaattccgcactgccgatatataaagaaaaagggggaattgcaatgtatcacaccctgaaaccgataatggccgcggccttgtgcatcagcctgttctccgccgcggcgcccgcgcacgccgagacgcatgaccgggacgttatcgtggtgtacaaaaatcaaaacggcaaggaatccgccatagacagcggagcggatgtggaacagacctatcagcatcttccggcagtcgccgtgtcagccgattcgcaaacggtgaaagacctgaaacaggaccctgacatcttatatgtagaagagaatgtatcctttcaggcagcaggcggttctgatatccgcccgttatcagcggcccaaagcagcagttacgtgctgccgcaatgggatatcgaaccgactcaggttaagcaggcgtggaaagaaggcttgacgggaaaaaaggtgaaagtggctgtcattgacagcggcatttaccctcatgatgatctctccattgccggaggctattccgcagtcagctatactccctcatacaaagatgacaacggacacgggacgcatgtcgccggaatcattgcggccaaacatgacggatacggcattgacggcatcgcgccggatgtccggttatatgcggttaaagcattagacagaaaaggagcgggagatctcaaaagccttcttaaagcgatcgactggtcgatcgccaataaaatggacatcatcaatatgagcctcgggacaaacgcagacagcaaaagtcttcacgacgccgttgacaaagcttacaaaaaaggaatcgtgatcgttgccgccgcaggaaacgacggcaacaaaaaacccgtcaattatccgggcgcctacagcagcgtaacggcagtctcagcgtcaactgaaaaaaacgggctcgcagctttttccacgaccggaaaacaaattgagtttgccgcacccggcactaatattacgagcacgtatctgaatcaaatgtacgccacggctgacggcacatctcaagccgcgccgcacgtcaccggcatgttcgcgctgctcaggcagaaatacccggaggaaacaaatacacagctccggcagcagatgcagcaaaacgtcaaagatctgggcgctcccggacgtgacagccgattcgggtacggactggcgcaatatcacacaaaacaaaagagctttgccgaacgggccgtaataaaagcggaaaagacgaaaaagcaggcagatatcaatcaagcaaaaacggcagtcagcaaactgtccaagtcaaagggaaaaaccgctctcgaggcgcggatcaataaagttcagacggcaagaaatgtgacggacgcaagagacaaagtccggactgccgaaaaacaaaagaaaaaaaccgccgtcaatgccgcacaaagcgccatccgcaaattaccggccggttcagagaaaaaagggctgcaaaagcggctgaacgctgtcaactcaagccttttgagaacagctgaagccagcgtcaagcaggcggaaaaaaagacctctgaggccaacaccgcaaaagcccaaaaagcagtcagcgaaatccagccgggaaaagaaaaaaccgctctggaaaaacggcttggccggataaaagataaactcaaccggcagcaggcaagagacaaagtaaaaacggcggaaaaaaccaagacgaaaaaagcaaaatcagcggcgcaaacggcagtcagccgattgaagccgtctgccgaaaagaccagcctgcaaaaacgcgtgcgtgcgattcgggtgaaataataaaaaaaacgcttgtgagccggtcaacggcttcacaagcgttttcatcacacctgcctattggttcatggccgggcggtcaatcgtgttccatttcgtaaaggacatatatcggaaataatgatcacgatacgggtgcgaggtgcctgtattccaaggcttgtccccgccgcagaaatggacgatggccggttcggcacgtgtttctctgtaacgtatacggtcgatcagttcaggaggcgttttctcattcatgataatatgcgtctgcgcgttccagcgcggatgcagttcatgccattgatcatataagatcgcgttaagcgcgtcctgatcatgaaacacgagaaaatcctccgagctgttatcattgataaaatcaatcacttttttagaaatattctgttttctccaaggttcgaaatctataatcataataccggaattaaaatacttggcagtgtcgctgatattcatttttttcagtctttcatgctgtccggcatcttctaccgccgcaactattgccggggaaatatccaagtcccataaaaccgaaatatcttccatcacaattgcatcgcaatcgatgtaaatcatccg

SEQ ID NO: 121 - DNA, 83431 bp, Bacillus velezensis FL50S
gcgggttcagccatatggcggtcgtgaaaaaccgcgtctttttggaggataccagcctctttcagtacacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagataaaaaggagagatcatgaatgtcagataaaaaacagcagatcatcgaagcgtatcaattcagacacgctacaaaggaatttgatcctgagaaaaaaatttcagaaagtgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgactatgtcaaaaaccacttgcgggaagtcaaaaaaatgccggaagatatgtatgaaggctatatcagcaaaacggaagacttccagaaaaatgatttcaatctgcttgaatcagatcgcgcgctgtttgactgggcatccaaacagacttacatcgccctcggcaatatgatgacagccgctgcgcagatcggcatcgattcctgccctgttgaaggcttcaactacaaagagatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttaatgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcagtaatcgccccaatcgtgcccatgatgatcatagctgcggtaaccttcacaaaatccaccccgacaaacagtgtgaatatgccgatatcccccaattcttcttcaccgaatccctgaatcgaagtatgttttgttacggacataataaaaaacagcagcaatgcaatggtcagcatcgcagaaataaaggcggttacggttttgacgtttcctccattaatataaaaaagagtaatgctgcaaatcacggcggaagagagcaatgttaaaacaatcggattgatatgcggatctgtcatgaaaataatggtgagaaagagaaccccgaaatttaagaataacgcaataaaagacctcgctcctttttttccgccgataatgaccattaatagaaataaaatcgccgcgagaattacgatgacattcatgagcttgccttctttcgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatgttggtcatcgcccccatgatgtcttttccgatctccatcccggaacgtctgagagcttgtaatgagatacccttgttttcttcatataatccgaagacagatgacgtcatggtaatggctacatccatgaccgctcccagtgatccgataaataccccggccataaacactgtgtgataagggcgggttaaatactgcatttcctcatatctgagacctttctctccggttgccagcatcaccagatacgtaatcagcagggaaacgaaagtgcctgcgagcgtcgcggctatggcggcgtatgttttcgcgtgaaaaccgctgacaagcagcaatgagatgaccgtaaagatgagaatacagataccgcagatgaaaattaaccctatattaggatgcttcctgtacaaatccaatgcaaacgacagtaaaacggcgttaaacatcaggctgacgatcgaaaagaagccttgttttttgccgacgataagcaaggtgaagatgaaaacccaagcgatcagcaaaatctgtttatcccgttttttatctataatgcttcccgatatatctttgtttgatggttgccctttatcaaaagaaacgaatacttcatcgccaatcgaatatttctgatcattcgctccggataaagaatactgattggacaaatgaatgagctgccctttctgactgccgttttcaagtctggcagtgatcgtctgattgaaaatcttatctttgtttttatgcatgtcctgtacgtcagactggtgttccaaagttgttttcgtcactctggcaatcggccgctcataaaaagaagcgttgtgagtgacaaaaatgagcgagctgataaaacaaaacgctgttatcacgtaaaacagctttttcttgtaagacatgcggattcgtttgtttcctgtaatcttcaaaaaaagtcctccaaacaggcggcgccgtgtaaaagagaggtcccgccgtgaagtgttaaacgatgcggatgcagcctttcgcgaataacgttcatattttatcactcggccgtacggctgtcgactcagagggggaccggcagaaaaagctctcctgatatcagatcaggagagctcttgggatgaaacgcccgataaaagcggtctttttatgcttcgttcactttttttgcttttcttctttggtacagatacagtgccgttccgagcgcgctgatgagtaatccggcaagaaggatggaatacatcgttgtggctgtatcaggaagcaggccgcccggcgatactccgtcctgcgcagggccggatgacggtttttgtccgcttggctgctttccggagccgtgatctccgcttgtcggcggcgcgctcttcgtgtttgcgtttaatatggtgtattcactgaaatgatttgtataacccgtgacgagatcgtgtgaaaccgaaccgttgtctgtttttgtatagacgttctttttccggtctacatgataaataccgggctgtttcgcctttttcatattctcaatgcgcagggtgagctttaccggcgctttgaatgttttgatgtctttgtttttctgcttcattgtaaagtcgtatacatttgaaagcgccgccccgctaacttttcctttcggcgccacgccgaatcgtgtatcagctgaagcggcgtttgccataggcattttcatgctgaacttgtcatgcaggatcgtaagggaagaatccgatgttctgtcctttaacaggccgatttgttttttggtcacgttgagatcaatcggctttttggcgccgtcattcttatcgtaatacacgatcggcgtgttggcgtttttggcatagacggcaaatgcgctgtcatcttcaagcgtccacgaaccgtttttttgttttgtcggcaggtacacttcctgcgcgcggccgtcaactttcggttccaccgcttttcccgctttttcaagctgctcaacgaagacctcatagtcggcaaagccaaggtcttctttatgggacgcttcgttaaagacggaatatccgtctccgccttcaccgacaaagttactggtggcgactctgtatgtcttcttatcagaaatcggctttacactgccgtcatcctgtacggccgaagcttgaagaacacggtgtcccggctttttattcagtgtaaacgtgtatgttaaaccggcaacttgagggaaggcgccgccttgagcctcaattccgcttaacccttgttccagagcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgccggccgtcaagtgcgaccttcgttgaaccgactttttcatttttaactgagacgagctcttttttaaacggatcaagctcttttttcagatccgggtcttctttcgtctgctcattcaccggcagtgcttgaagagaggattgttccggcaggacgacgccgtttttgtcaaatgcgagatcgacacggcctaaatattcgccgtattcttttgcctgggcgacgatggtcggctcttcgtttttgacaatttccattttatctacaagcgtatgcgtatgtccgccgacgattaagtcgatgccttttacctttttggcgagatcgagatcacgctgatgcccgatatgggtcagggcgataattttattgacatgttccttgttctgtatttcttttactgtatcttgtgcggattggaaggcatcatgaaagacaatgctttttcccgggcttgatgtgacggacgtatcttctgtcgtcaagccgaacacggcgactttttctccgtttacatcaagcagaatatatggatagatgcctgcttttttctttttccctgccgtaaatgtgtctgcttttttcatgaatggtctgagttttgactctttggacacatcgacatttgagctgacgagcggaaagtcaggcgcttgaaaattgtattttccggacgggtcagacgcgctcccgttaccgctcaggaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttgattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcaggtttgtccctttgaccggaagaatggaccagttatgatcagcctgcggattaatcgttttctgctggatgatgtaatccattaagacctgcctgttctcatcggcagaagagtatacgattttatcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgccagcggaaatgtttgtatagtagtttgagccgttccgcccgccggctttaaacggggcgcccgccgagaggataggcagatctttgtactccgtatccttcatcttattttcggcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgatcagcgcctttgtattcggcatcagggaaaagaccgtgctgatggcccgatacgatcgcatcaattccgctgactttcgttgccagatcaaaaacggcattttccgctccggaagactgcgcttttttttcgatgccgctgtgggcgagggcgatgacgatatcggcaccttcagctttcattttcggaacggttttctttgcggattccacaatgtcctcgacctgaacgcggccttcgagatttttcttatcccacgtcatgatctggggaggaacaaagccgatatagccgacttttagctgatgcttgccgccgttttcatccgtgacggttttgtcttttatgacataaggcgtataacggttttcgccgcttactgttttcacattggcgttaacgatcggataatcagcgcctttgattgtcccgtccaggaattcaagcccgtaattaaattcatgattgccgagtgttcctgcgtcataatgcagactgttcatcacttcaatgatcggatgggtctttgcgcctgaaatgatatcatttttctcatattttacggcgtattctccgaggggattcccctgaatcaggtctccgttatcgacaagcagcgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggcaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgccatctgccacggccctcagcttctcatcaacgcgaaagcattggacgggcgcaaagcgacaggatttacttcaatccgaatcgacatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgttgttttttgtgctgggaattggtgattttatgatgcagcaattgagccgcttcttttcccgactgccgcggaaaggaagaaacggttgtaagcggaggataagaaatttcagcttccggcacgttatcaaagccgacaatgtcaatatcttcgcccggaacgagcccggcttttctgatcccttgcatgacgccgaacgcgaccaaatcactgaagcagaaaatcgcggtcgggcgctcagaccggcggaggagctccgtcacggcgtcacagcctgcttcgcgggtcggcgcgctgtcaatgacatattcatttttcacttccagatccgcttcacggagcgcttttttaaaccctttcatacgcttcgtccatgttgatgagtgcttcacgccgcccagaaacgcaatctcctgatggcctttctcaatgaaatgacgcactgccttataggtgccttcctcataatcggctccgacaaaatcacagttggcatcggcaatctccctgacggcgagcacgaccggaatgtcaagctgctcaaggcgggaaagggtttcctcagccgtccctgaaaccggacacaaaatcaatccgccgaccctgtgctccagcatggtcgagatcagctgctcctgcttggcgacggaatcaaatgtcgtgcctaacagcaccgttaatccgacttcctcaagcgtattctgaacgccgatcagaaactctgagaaaaacgtattggaaatgtcagtgataatcaatcctaccgttgtggacgtctgtgatcgtaaattcgcggcgacccgatcatatacgtaccccagctcccgcatggattgcagcactttctcacgggtcgcttcggaaattcggggattattgcggacaattaatgaagcggtggatgttgagacgccggcatgttcggcgacctgctgcaatgtcacccggcgttttttttgctgtttcatacgtcgcattcctcacttggttttattcgttacatccattataagcgttttggcgcatgagaagaaagagagaggagggagaaaaagataaagcgccggaagacggattgtccttcggcgcttctgtcacaataggttattcaaacatttgctctttaatatactgaaccggcatttcacggcctgtccaatattcaaacgccatggcgccctgccaaagcatcatgccgagaccgttaatggtgttgcagccggctgcttgagcttgttcaagcaatttcgacgtaacggggttgtaaacgacgtctgtcacaatcaaatccggacggagcatggatgtatcttcaataacactcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttgcctgtgatatcgatgccgtgttcttttaagttgcggacgtatcccataccgtcagtggagtggccgatcagtctgccgttttcattaacgactgtatttaccgcgccggtgaatttcgctgaatccgcgagttcatcgagataagggagaatgttcatcttgttcggcatcgagacattgaagcctctgacgtttaaggcgcgcattcccgttaccacatcttccagctgttcattgccgacttcaaacgcgaggtaagcgtagttcaatcctaattttttaaacgccaggttgtgcatcgccggagataatgagtgtccgatcggtgtcgcgaataatccgataagctgagtttttccgttaatccgtcctaattctttcttcatgatgtattcctccgttagtccattcatttgtttttcatcccgctttgagggcaaaaaacgctgattacatatgtttatttaaaatgctgagtacgctgcgcaattcctcaacgggaatctgcccgggcgctgatgcttctttgcccgctccgaacgtgcacgctgagccgaagacttcgccggccagccggctgatcaggcctgttcccgccattgacatcgtgatgatcggccggtccgcgtattgtgttttcatcgtgtgagtggcatccaataagacgaaaacatcttcagtgctttgcggcatcaccgcgattttcggaatgtgcgcgccgtacgcctgcatgttccggagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatatgttttgtttcgatggcggttttaagcaattcaatgtaaaagcggtcatcaataactttatttccgccttctttatgggttctgaatgtgaaaagcagcggtgttgcgcctgcggctttccgcagcttttcaagcatgccttttacggcgtccaggctgtcaacatgctcgtatacatccgcccgccactcaatgatatccgggcgaagcctgttgacggcttcaatttcttcgagcagttctttctctccggccgccatcagcggcacaatgatcttcggaagcccttcaccgatgaccgtgtttctgattgtgatagattgcatgataaatcctctcccttaaaaaatagtcaggctttcatcacttgcttaaagcggattccgataaacaatgcgaggagggcgctgacggccgcaattccgatatcaagcagaaaaacaggcgtcaggccggcggctttggatatcgctcccgttacaagcggaatgacaataaaagataagcttgatgctatattaacaaaagatgtgattgtacctttatttttagggaataaaacagccataaccgtcatcgccaattgcagaatgcccgcagttgaaagtccgatgacaaaggagctgatgaccgatacggccggctgctgaatgaaaatcagagcaagcagcgcgattgccgcgatcacagggtacagcaccattaccgtaatcggctgaatcactctgtttaacagcacagccagcaataacacggacacaagcgccccgatgctgtaatagctcaacaatttgacggcctgcacctcaggcatgcccaaaacggattgcccgaacttaggaagccatacttgaacgagcataaacagcgccgttgatgaaaagcctaacagaatgatcgcaacgccttcgcgccatatcgacggctgtgatgtgaacgcgtcatcagacggagaggcttccgtccggccgccgtcttctttttgcttatgattcggaaacggaactttcaacagaaaaaagccgttcaggaagaaaataatgcccggtacgaaaaacgtccagccgtaaaacaaatgcctgtccgcaataaacgcgataaaaaacggaagcaccgtcgcgccgattgatacaaatgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccattcccctttattgaaccactgcctttctttgaaaactgtttgatacaacggttgcatagacaaacttgaataacgctgatatcacaatgagtatatcgttctactaaacaaaaaaagataagcggcccgctcatttagtatatcgttctaccaagttcacagttactatactccttctttttatatgtgtcaaaccgatgaacttttattttttacttttttaaatcaaaaaagacccgccgtttttcggcaggtctgacatgggtttatttcctgagagaggcgagctcctcggcaatggcctgcatttcactcggactgaatgatgcttttttcatgaccatttgatgaaggtatgtaagatcttctattttttcatcactgaaatcttccgctctgatgacgccgacattgagcatgttgagcttttgcgaaatgtcttcaatcattttatttaacgtttctgtttgttggctcggcaaattcatgcatcctttcatgaccgttttcgtaccctttattctaacagaattcatttagaataaaagcttatttccacagccgcagaaaaattgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctgaaggagaaagggatcagcgcaagcggcatcacggcgaggcaggtccgtgagtctgatctgaccgattttgattacgtcattgcgatggatgcagaaaatatcggacatctgcgcagcatggccggttataaaaaagcggcgccgcgtattgcaaggctgcttgattatgtaccggagtcagaccttgccgacgtgcccgatccgtattataccgaaaatttcagcgaggtgtacgctttggtcgagtccgggtgccgtcatttgctggagacaataaagaaagaccatcatttataagggggattgaccgatgaagcagacacgcatcatggcaaaagcgattctgatcggcgctgccgccggcggagcactgtccttattacataagccgacgagagaggcatgtttccggaacatggacgcgtgcaggcggcgtgcggcattttaccgaaaacatcctgaagccctgaagcagcaggcttccgcaaaactggatcaagtgaaaaacattgccaataccgtatcggaagatctgagttttttaaacgggcagatcaccaagctgaagcagacgacgccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttgatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcactgcttctgccggtgttcggcagagaaatcggaatgctggccgcggatttcatcggcgcctcggacctgtttttgcaggtgtggtcggttgtccgctggggtatcagtccgcttatccttttaatcgtgtttaccgcgctttacatattcgcgccgaataaaaagctttccctccgttttgtcctgccgggagctgtattcgcggcagccggctggattatcgtcagtatgctgttctcattttacgtcggcacctttgccaactacagcgccacatacgggagcatcgggggaattatcgtccttatgatctggttttaccttacgggaaccctgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgaggctgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacttccgatggcaaaagcgggcaatatcagcgcgacggcatccacggatatgcctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaacgggccgacagcgaatccaagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagaagcatgccttgggaaaatccggagatggaaacaagcagaaccaaaataaagaagtacagtcgtgacatcgcgtatttctccttcttcagtatctttcttgatcgtacacggatttgccgcgtccggcaacctgaaaatgccaattcgggctgccgaggaagtgtaattgaaggagtttttgagaaggatataaaaagacttattcgaaaaaaggagccaggcagatatgaatcggatttttttctttacggctgcggcgggagtgccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggcaatgcggtagagctgattatatcgattttcgccttaaaagaagggctgacgggcatcgtgcttgcttcactgaccggttcggtgctcggcaatcttttgctcgtcgcgggattgtcattttttatcggcggtttgaaatacaagcggcaggaattcaatattcatgatgcccggcataattcaggcctgctgatttttgccattatcgtagcttttgtcattcccgaagtgttttccatggatatgggggaaaaaaacaagcttgatttgagtgtcggcatcagcatcatcatgatccttttgtacgtggcagctctttatttcaagctcgtcactcaccgcggtgtttatcagccgaatcagccggaggcaaaggaagaagaggagcagccagagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacactgattctgctgttatcctttagttttttcgcaatgccgtctgccggtgcaaagaaaccgtttaaggttcccaactctgttgtaagcatttcaaaggaaaatacgtatccgaatgcttcacaggaccagccgatgcttcagccgagcaaactggcaaaggaattgttagatacatccgagatcaacatcgaaaatccgcatctgataaaaatgctgaatgaatcctcggtttccggttcaccgcttgccatcggctaccgggcgacaatatttctcgggaaatgggcgctcggctatcaatcgaacgaaacggtcgccaactgggaatataaaaaaatcaatacgaacagagcggataaccggggcggacagcaaaccgcggttatctcatacgcccaagaacagcagtacaaaatcaaaggcgggctcacagcgaaggtgccgaacgcagaagacgtaaaaagcatgatgatgcaaaaagcgatgaagaaaacaaaactgccgctcgcgtttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtgcaggatcacgtcacattcggttttcaaatgacagcgcagccgagataaataaaaaaagctgattccggttcgggaatcagcttttttgtgtgtgatacatttcctcaagcaattgcacattgttgttgtacagctcccgggcaagaacgcgtctcaccgcaaggcttgccgagaagtattctttatcttgaaccatgcctttgacggtaaattctatgcctctcgtcaatttgttcaggctcatgattccatgcacttgaaacggctccgtcgcattgagaaattcatcccgcttcagtgaatcgcaaagctcatcattgagcatgtcgcaggctttttctaagacggcatatacccgctcgggatcttctttataactgatcacgacggactcggtaatccgcataaaatcaatattatagttttgaagctgtctgacctcaccgtttgaaatggtaagcagcttgccggtccactcacggatctggagggaacggagcccgatttcttcgactgtgccgttgaacagattgttaattgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataacgaaatgacgtaaaagataaaaccgatcgtcgctgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatatccgtaattgtcgtttccatcttctgttaacctctggcttttcgtaatgaaaaatccgtgtcctgataataactgtttttgacaaggacgttcggtccgaggcaccggacgtttgtgcagcggcagttcagctccttgctcagcttcgtctgtctccacttgtcatatgcatcgggaaggctgtctgttttaatattgccgagcggcggtgtatcgccgaaatccgtgacaatgatatttccgtcaaaaatgttgacgttcaggcgggagcggccgtcagggtcgtttcgcaccgtaacgtttttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtccgcttgttcagcatcgtttccgctgaaaccattacgcctgcttcgaccagcgtgcggctgttttcaatcattttatcaaaatagcgcgcccgctgttcaaatgtcggtttcttctccatcatcgcaaatccgatgtcggcaaagtcctcgaccgttccccaattgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcgatcggcagcgcatccgggtctttcggctggagcgtgtacccgacggcgcagtgctcgcatctcatattgcacaaagtcgtcgttgtgaattcaacgttcgtcagtttcatatctccatactggtcgacatccatgtacgcttcccaaggatcgtactccggtgtaatcggacgcagtgctgtgttttgtgtcatgactatctaactcctttataaatgggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcatcggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagcggtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacaccccgaaagtgcttgatgtgttaaaaaaacatcacgtcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaatctgtatctccgtccgccgcgcggcgtattcagcgaatatgtcctcaaagaaacgaagcgcctcggctaccaaaccgttttctggtccgtcgcatttgtcgactggaaggttaacgagcaaaaagggaaacaatacgcctatgatcacatgataaagcaggcgcatcccggcgcgatctaccttcttcacaccgtttcaaaggacaattcagaagctctggacgatgccattaccgatttgaaaaaagaaggctacacgtttaaaagcattgatgacctgatgtttgagaaagaaatgaagctgccgcgcctgtagaaaacacctctcctggtaatggagaggtgttttgttatttgatacatttaatcaatgccgcccaatccaaatctccgcagccttgtgcgatcccgctttcaaaatggctcttcgccagttcggcaagagggagttttgcggaaacctgttctgcggcggcgagcgccagattggtatccttgagccctaaagacattttgaagccggccggctcaaatttctcctcagccatgatcgtgccgtaattttgatagacgggagagccaaagagcgcgttggcaatttctagaaattgtttttgttctaaaccgaacttatccatcattaagaatgattcagataacgcctccagcatagaaacgagcaagaaattgacgctgattttcgcggcattggccgtttttgtttcttcacccgtgtcaaatacttgctgactcaggatgttaaacagcggttcggcctttttcttcgcttctgccggtccggctgtgatgatgcgaagctcggccttctcggcggcatcggggcggccgaggacgggagcggcaataaaggactgccctctgcccgaatgtgcagcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacaatggcgatcttcatttgacagtccctccaatgaaaagttttccaccattatacatgcaaaatggttaatctgctgtgtataggattgccactttcagttcaggttctgaagaccatccggagtctgatgcggctgtccccttataaaatccggtaaatcgggttttgatgattgtttttgaacggggttttacagtgaatgtttttgatttgaatgtgacgtcctttatgttttctgataaatccggcgtgacagaaatggtttgttccccttttccgtaatgattgatataaagcgtgcagctcatgcccgctctttttcgctcaatcagatgactgcattcgctgcggtgcttcaaatattcgacagactcttcttcgggcgcgaactgttttaaggaaaaagcggcatattcggtggcaggactgataccggaagcggcccccatactgagaaagatcagaaacagccccgccgcgggaagcgtccgcctgaacgcggcggcacaccagattaacgccgcaaagtaaaggacgaccccgggaatgacggagatatgggctccgtcttcagaccaggaagaaaagccgagcgactcaaagatgtaatcagacaccgtacagccgttatacagcggggcaatggacataacactgaatagcaggaggacagaagaaatgattttgtgagaaaagatggtaacggcgcacacctctttacgtttttttccagactatcatgttttctcaaaaaaagaacagccggcagccgttcttacttgaaaatattaaaccagcctttgcgggcgaaccaaaacagcatggcggcgacaagaacggccatgacgcccaaaacgataaaatacccgtatttccaatgaagctcaggcatgttatcgaaattcatgccgtaaacccccacgatgaacgtcagcgggataaaaatggtcgagacgatggttaatgtcatcataatggcgttcatccggtttgaattcagcgtcacatagctgtcccgcaaatctgacgtcatatcacggtttgactcgatcagctcggccagttttaacagatggtcataaatatcgctgaaatacgccttcgtttcacggctttcttttacatggtcaaggctcaaaatccggtacattaaatcgcgcatcggaatgatcgtccgcctcaggttcaaaagatcagtccgcaattcaaacacttcattcattaaagtgccgtaagatttatgtgttctgctgtcttcaatttcattcagccggtcttcaattttgtacagcacggggaaatattcatcgacaagctgatccataatcatataagtgatgtgccccggcccttttttggctaaccccggagaagcgaaaaaccgttctctcacccttgagacgccgggcgattcgtgcaaatggaagctgacgatgaaacggtcggactgaaaaatgtccacctcttccatttccagtgtgtccgggttcaaggcgtggagcacataaaaacggtagccgtcataatggtcgattttcggccgctgcatatgctgaaagcaatcctcgatcgcaagcggatgaaagtgaaaataatcccgcagcagctcggtttcatgcatctcagcgccgaaaaaatcgatccagtaccatgcgatgtccggttgttctgtacgtgatagggggatattatctaatatctcattatgtgttgtgattgcggttatatgtatcataaacaaccctccgcctgccattatatcatgcggcgttatgaagaaaagtatacgaattgccgcccgcccgcttcatgatatacttggacaaaaaggggtggagcatatgtggaaggaaaccgtttcggtcacgccgccgtatcattttgataaagtccttgaaaggctgtcgctcgatccgctgaatgcggtcgatcttcatgcaagatcaatcaaagtgccgctcagaacacgggacggcaaactgtccgtcatcacggttcaagcggaaggcaccgccgcagacccggtcttcctcgtcagcggagaaacggaccgcgaggagatgattgaacggatcaaacacatttttcaatgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgaaccgaaaacgattgcggcgcttgagtatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggcctcggccgcccgaatctgtttcctttggcggatatcggcctgcaaaatgccatcaaacgccgcttcgcccttgaggataaaccgtcaaaagacgtgatgcttcaggtaagcagcgaatgggcgccgtatttaagctatgcgtccttgtatttgtggagaagtattgaatgaaaaaccgctttgaggatttttggaaacttccagtgaaaaacatgaaggaacagccggctgcatgttatactgaaaagatgtgatatttcaaatcagccgttttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaaaatccgcaagccgtctgaacaccgcgtcacgccgccatgcccggtctacgaccagtgcggcggctgtcagcttcagcatctggcatacacccagcagcttcgcgaaaaacgcgatttttttttttcaagcagaagacggcatacgagattcaatgtcgaagaaatgaacattaaagatacgatcggaatggacaacccttggaattaccggaacaaaagccagttccaagtcggacgctcgcaaagcggcagcatcattgccggcttatacggacttgattcccataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccatcgtgacgagagtcggttttgaaacaggcgaagtgcaggtcgtgcttgtcactgcgaaagagacactgccgaataaagatgagatcgtcaaagccattcagaaccggctgccggaagtgaaatcgattattcaaaacgtcaatggcgcgcgcacatccgtcattttcggtgacaaaacaaaagcgctggcaggaagccatgccattcaagaagtgctcggtgacgtgtcatttgaactgagcgcccgcgccttcttccagctcaaccctgagcagacggtcaagctatatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacgggaacagccgaacactggctcccgaaatggacgaaagaaggcttccgtcccgacgtggtcatcgtcgacccgccgcgaacgggctgtgacagaacatttttagataccatcaaaaaagtaaaaccgaaacgcttcgtctacgtatcctgcaatccttccacactggcgaaagacttgcaggcgctgtcgaaagactatcgcgtcgaatatattcagcctgttgatatgtttccgcagacggcccatgtggaagctgtggcgaagcttgtgttgaaatcgtctaactaaaataaacaattcgtaatcagacctggatttcggtataaacatttccgatttccgggttttttttatgcgcagcctttgccctggctgtcttttctaaactttatcttccctcttttctcggagatctttaacttaaactgatgaaaagagttgaaaaaacgtgtgggaaagcgaggagaaaacagccaattttgacctcgtttgtataatgacgctgtggtttattgtggcattaatgggataatgtaaaataatttgatatcattggtttgagatgaagttgtaacattattcaactgtaaagtatttatcatgccaaagtaagtaggtctttaataaatgataaaaaggaggtgaaaccgaacgagagatattgggatttcaacaactgaacgaaggttctgaagtagaagctgtaaaaggcaagggtgcttactttcaataatcacagcggcagttggcatatcaacaactgtcgataaaagatcaaatacactaaaaaagcatgtttggtcgttatatataatatgaaagcctaaacaggaaaaggaccccaactatttctcttgttccaaaaaaggaataaatatgaggcggaaccgcaagagataacaactattacagtaatacctgcgatggttatatccttaataagtaattattgcgtcaatcatgcttcatcatataatgatgttagattgacactaggctaaaaagtattgcagaaaaggaaatggataaagaaatgggtaaagtatataaaagaagttggtttcacacgttgttggcatttttagtatcacagctttattttaactttgtagaattaacgggatggggtcctaattatagagaaatgaatggattcccagcaaatatagctgaactggatttctttcaaacatatctttcattctatgataatccatggtttaatattgtcactgttttcttgggggttttcactgttatacaaatcattacaggtataacaaagaatatccgaaatgaaagcaataacttctgatgccttatttaatgatgaaagaacatgaacactttctaattaatcttatgaatgaagactgcggcacttagtcagcagtctattttattggttttggatcaggattaccgaagcgtaaccttatacaaatatatataggtgattgtataaagatattaacatacggggtttaaaagccgatcaacccttagtacatatactgtatagagccaagccacttgcggcgttggttatttctaaaccataagcaaatccgaaaagatccagattgaagttcttgaattctgttaagttcgagtttattttcccatgccatcctctttactccatgtgattcaccagcggcaagttaaggctttttctttttacattcttttcagtactcagatataccccccagccccatttgcttaatcaacttatttcttgaaatttgttttatggtaatagggagaactcatatgatattctatttaggttggaatcctttttatccaaaaagagcaaaagtaaggccgctaagaaagatgaaggtcagcgctaatcttaataaaccacaatataaataaaaattaggtgtagataatcatcacactttttctctctcaaacccttttaaaggtgaaggagttgactgagttgatcagaaataaacgatatggggttaactatagcggtagtctattacgttaactcaattaatgtgttctactccagtttgcttttttacttttaacgtgtaaaaagtgaaatgttcaaaatttactatcgtttgataagaagtgctgacacatgctataagtgtaaaagaagcatggtcagtttttaattttgggataaaggtttcgctgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattgggatggcggaattagggtttaagggcctggatatcaatatgggctgtcctgtccctaatgtggcggggaatggaaagggaagcggcctgatttgccgtcctgaagttgcagccgaattaatacaggcggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaatcaagaaacttcgtgacgagattgcgccggatacccttttgacgatcaatggggatattcctgaccgtgaaaccggcttgaaacttgctgaacaatacggtgttgacgggattatgattggacgaggcatttttactaatccgttcgcctttgaaaaggagccgagagagcatagcagtaaggaattgcttgatcttttgagattgcatctggatcttcatgatgaatattcaaaagcagaagccagagcatataaaccgctcccccgctttttcaaaatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcatcatccggcccggatttcggtttgaattccgggcctttttgtgtgcagcttttacccagacagatccatggccggtttcgtcatgcagaaataaacgaataatggtacattgatagaagatacatcataaagggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggatttcttcgtccggatgatactgttcccggaaattacgatgtcacttttggaaccggtcacccggagatcatggcagcggacgagctgcgccgtcaatttcatgaaaaaggcttttccgacgtcgaagagcttgtcatgcttggcgggaaaaaataccgaagcgttctaaacgccgtcatcggagagcatcagcatatcacctggcctctgtcatcgtataaaggcattggttacatgcttcaagcgctgaatcgggctgttgaagaaaaggatgaactgcagcgcgtggatatgaaaaaaagagtgtaaccactcaaacgccgtgatagactgtatgcggaagaatgaagcaataaaagatttccgaggaaataaatacgtcgatcattgtcaaagacagggtgatgcccggtcttttttgtatgccataaaacgagacaaagggaacggatcgagacaaaatgagacacctgtctcaaactgtctccattgaaaaaataaaaacattcattttacgggcttcaaaggctggcatgcttcttgcatttataagtgtgaaccctaaatagaaggaggcgcacaaaatggaattgttaaaacgagaaggcttgtcattaactgaggaaaaagcgctgtggatgtaccaaaagatgctggaaatcaggggctttgaagacaaagtgcatgaacttttcgcgcaaggagtgcttcccggattcgtccatttgtatgccggtgaagaagcggtagctgcgggggtgtgcgctcatttacatgatggcgacagcattacaagcacacacaggggacatggccattgtatcgccaaaggctgtgatctggacggcatgatggcggaaatattcggaaaagcgaccggactgtgtaaaggcaaaggcggttctatgcacattgcggatcttgataaaggcatgttaggcgcaaatggaatcgtcgggggcggatttacgctcgcatgcggatcagcgctcacggctaaatataaacaaactaaaaatgtaagcgtttgctttttcggagacggagccaataaccaaggtaccttccatgaagggctgaacttagcggcagtatggaaccttcctgtcgtgttcatcgccgaaaacaacggctacggcgaagccacgacatttgagtacgcctcagcctgtgattcaatcgccgatcgggcggctgcctacaacatgccgggggtcacggtggacggaaaagatattttagcggtttatcaggcagccggggaagcgatagaaagagcaagaaacggcggaggcccgtctttgattgaatgtatgacttacagaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccttatccgaaagagtctgagctgttgacagacgtctacgtgtcatatgaaaaagggggaatgtaagatggcgagagtcataagcatgtcggacgcgatcaatgaagcaatgaagcttgcgatgagaagagatgaaaatgtgcttttaatcggtgaggatgtcgccgggggagcggcggtcgatcatttgcaagatgatgaggcatggggcggtgtactcggggtcacaaagggtctcgtacaggaattcgggcgcagccgagtgctggatacaccgatttctgaggcgggctatatgggtgcggccatggctgcggcatccacggggctgagaccgattgccgagctgatgtttaacgattttatcggaacgtgctttgaccaagtgattaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccgggtctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcgaaggcagcgacatcacgctgtttgcggtcggcaagcaggttaataccgcgcttgaagcggctgcacagctttctgagaaaggcatcgacgccgaggtgcttgacccccggagtctgtctcctctagatgaggaagcgattttcacatcgttagaaaaaacaaaccggctgatcatcattgacgaagccaatccgcgctgcagcatcgccacggatattgctgcgattgtcgccgataagggctttgatttgcttgatgcgccgattaagcggattacagcgccgcatacaccggtgccgttttcgccggtgcttgaagatcaatatttgccgacaccagaccgtattgtcagcgtcacacttgaattgcttggcgagccggcaatgaattaaaggagggatatagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcatattaaagtcaaagagggagaaggggtcccgccgggaacacccatctgttatatcggggaaaacggcgaagaagtgcgggagaaggaggcgccggctcctgaaaaagcagggaaaccgcaagctgaacctgaacatattcccgctccaaaagccgggcaaaagcgcaaacaccgcgtgaaaatatctcccgttgcccgaaaaatggcggagaaagccgggttgaaagtcgatacgctgaacgggacggggcccggaggccgaatcgtaaaagctgacgtcatcaaggccatgaagacagaagctgaaccgcagtcttcggttcagacggcacagccggagggaaaaccggcttcagcgatgagaaaagtgattgcagaccgaatgcacaaaagcctgcaaaacagcgcccagctgacgctgacgatgaaagcggacattacggagcttgtaaaatggcagcagcagctcgccgacagcgcgaaaaagcggagcggtgttaaactgacggtcacacatttcgtatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgccgggcgcgggaaggcaatgcttccggagatgatctgcacggatcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcatcatgctgccgctgagccttacctttgatcacagagtatgtgacggcgccccggctgcggacttcctgaaaacggtcaaagcgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgcttggaggcacttgtctcaatgaggggtgcatcccgacaaagtcgcttttggaaagtgcgaatgtgctcgataaaatcaggcatgcaaatacattcggcatcgaactgccgcaaaacattacactcaattggaaccgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtaatcgacagcaaagatgcgctttctttacagaaaatcccttcgtctctgctcattgtcgggggaggtgtgatcggctgcgaatttgcctctttattcagccggtttaaaacgaaagtgacggtgattgaatcggctgaccggctgctcccggcagaagacggggaaatcgccgccgttttcgaagcctctttaagagacagcggggctgatattcagacaaaagccgcccttcagcggattgacaaagaaaggaaaaccgccgtgtggacaaaagacggaaaagaaattgaggctcaggctgatcacattttggttgcaatcggcagaaagccgcgtttgcaaggcctgaatctggagcaggccggcatccggtattctccgcgcggcattgaagtcaatgaccatatgcagaccaatgtgcctcatatatatgcgtgcggcgatgcggccggaggattgcagctcgcgcatgccgccattcatgaaggaatcacagccgccgcgcatgcttcgggaaaggatagcaaagtcaatatgcgggcggtgccccgctgtatttatacatcgccggaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgagccggaattcggagaaatcgtcggggtgtcaatgatcggaccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggacttgcggtgcattccgtataaccggaataccctttctcagatgagaaggggtatttttcgttgaaagcgctttacttttcccctacaatatatgaaaagatggtctgaacaggggggagcgaatacaatgaatgtcattcggaatgattttaaaacctggaagcgttttgtgaaagaaggcgtgctcgatgaatcccgtattcagaagcgggtggccgcctcatggcaccgctgcaaaaaagccgacgtcaacccttatctagaaaagggaccgaatgtaatgccggcagatcatttagaaaggcaggccgaaaagcatgcgttatttttagcggcctcaacaccgcatgcagaaagaatgaaaacagcgatgcgggaaatggaaatgatggttctcctgattgattcagacggcgttgtccattcagttgacggccacccgcgcaccattcatgaagcgaaccgcatcaatttcttaaaaggcgcccgctggacggaaacggccgtcggcacgaatgcgatcgggacggctctttatacaaatgaaccggtcatgatacacggctctgaacattattcgctcgcttcgcatcaatggagctgttccgccgcgcccatccgttatgaagacgggcggctggcgggtgtcattgatatttcctgccccgccgcccacgctcagccttttatgctcggaattgcctcctccatcgcttatacggcggaacgggagcttgccctaaagatcaaaatgacagaacttgacatgatcagcaaattcgccgggcttacccggtctcatgatccgatcgtgctttgcaatgaaatgagccgggttatcgctgcaagccgtcccgttcagcattttaccggacatatgctgcgcgagcttgaggaacagggctatcatatcaagcggacgaagcgggaggagaacggcttctcatgcatttacttatccaaacgggaagaaaagccgtcgtttatatttcatggtgcggcaggcaaaagcccgtcatcccgacatatgcttcagcagctggagcttgtcgcccgaacggacgcaaccgtttgtcttacgggagaaaccgggacgggaaaggagattgccgcccgggcgattcataacaacagctccaggaaaaacggcccgtttgtcgctgtcaactgcggggctgtccccgaaaagctgattgaaagcgaactgttcggctactcggaaggcgccttcaccggggccaaacggaaaggacatagcggcgctttgcaaaaagcagataaaggcacgcttttcctcgatgaaatcggagaaatatcacactccatgcaggtggctctgttacgggtgctgcaggagcggaaagtcaccccggtcggcgggacaaaagagattcccgttgacatcagaatcatcactgccacccacactgatctgagacagcttgtcgaatgcaaaaagctgagagaagatttattttaccggcttcacgtctgtccgatccacctccctccattaagagaacgcaccgaagacattcccggactcttccttgaatttcagcgaaatcgcggctggcggggggagcttcctgttgactttttagacgtattaaagagccggaaatggccggggaacatcagggaattgtttaatgtatttgaacgtctttccgtcatgttcccggacggacggctgtcagggcgccccatcgcagccctgcttgaagcgtcaggtcttaaagaagcggccgagtcttatgaacaggaagaagcgtcctctgtctccatccgggagcacattcagaaaaacatcatcgtaaacgcgcttgaatcagcgaaggggaatgtcacgctggctgccaaaatggccggaatcccgcggagcacgttttacaaacgcctcaaaaaattcaaactcaccgccggacaattgtaagaaacaagcatacttctcttggctgccggacacgttatgtgtgaggactaaaggaggtttgagacgtgaatacacagcgtgcgaaagacatttcggaatccgccgccatggcgtatgtgacgtatgaaggagtcccgatttatattcagcatgtcaacgaagacaaggaaacagccaggatttttccgatcggaaatccacaatttgagcaggaagtgctgctttctgatttacaagagcatttttgagaaggggtctgctgatgacagcaggcctttttcgtacctgtgggaactttcccgctttttgagaaaaataactaaaaatgatcaaatgatctaactccttcaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatacgcgatgcgcgcgctcgatgaacaaatcccgctgaagtacggcgtggtcggccaggaaacatgcgggccgggcggaatcgcatacggcatgcgctctatcggcggtgttcttgagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcacggatcgagaaggcaatgatttaatgccgaagctgaaagagcatgtccgtgaatacggctacgttccgaagacggaggccgaacagactgaagcaagctggaatgacaccttcaaaaaagcgcgcgacgtacaggcggcggatccggatacgcttccgaacacatatctgcaatattacttattcccggatgatatggtgaaaaaatcaaatccgaaccatacgagagccaacgaagtcatggaagggcgcgaagctttcattttcagccaatgcgatatgattacgcgcgaacaatcatcggagaacagtgaaattaaaattgatgatcatgcttcctatatcgtcgatcttgcccgggccatcgcttataacaccggggagagaatgctgttaatcgttgaaaataacggcgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcatttcaaaagctgtggcaggcgctgatcctgtcaaaaacagtgccgaatgcccgtgtggcaagactgattcttgaagatctgatggaggctaataaggactactggcctgagcttgatgtaagcccatctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataaacatacgtgctaccatctcggtatcaatgacatggcgaaagcctgtaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttaatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtactggcgcaaacgacgccgtataatctttatgcgaccagcaagccggtgacgttaagcgataaaacggaaatcgtcgcatttgccccgttttttctggtgggcgaagcgttattccgtgcatatgttgattataaagagctcgaaaattttgataaatagcgggaggtcacgtgaaatgatgcaaaaagtccagcgcttcggcagcgcgatgtttgtgcctgttttattatttgcattttccggtattattgtcggtctgagcacgctgtttaaaaataaaacgctgatggggccgctggctgatcctgacgggttttggtatcaatgctggtacgtcattgaacagggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccggcatcaaaacgcttgatacgaatattatcggcgccatctttatttcatctattgtcgtgtatttgcacaatcgttactttgataaaaaactgccggattttctggggatttttcaaggatcttcctacatcgttatcatttctttcttcattatgataccgatttcacttgcggtggcatacgtatggccgatggttcagtccggaatcggatcgctgcaaagttttctcgtttcttccggggcgatcggcgtgtggatttacacattcctggagcggattttaattccgaccggcctgcatcattttatttactcgccgtttatttacggtccggctgtggctgaaggcggtatcgtcacctattgggcccagcatctcggggaatactctcaaagcgtcaaaccgctgaaagaattgttcccgcaggggggcttcgcgcttcacggcaactcgaaaatcttcggcattccgggaatcgcgctcgctttttacgccacggcttcaaaggaaaagaaaaaaatcgtcgccggccttttgatcccggtcaccttgacgtccattgtagcggggattacagagccgattgaatttacattcctttttatctcgccgtttttatttgcggttcatgctttgcttgccgcttccatggcaaccgtcatgtatatggcaggcgtcgtcggaaatatgggaggcggtttgatcgaagctgcgaccttgaactggatcccgctggcgtcaagccacggtttgacgtatgtataccagatcatcatcgggctgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacggctgcggcagacgaaacacagcgggatacagccgctttgtatattgaagcgctgggcggaaaggacaatattacggaggtcaccaattgcgccacccgtctccgcgtcactgtcgctgatgaatcaaaggtcaaaagtgacgccgatttcagagagctgggagcccacggcgtcgtcagaaaaggcagggcgcttcaggtcattgtcggattaggcgttccgcaaatgcgggagcgcattgaacagcaattggatcaataaggtcaaaaccttcccctccccgggaaggttttatctttttcgcagattattgaaaaaacggcacaccaaatttctttattcatttgccggaaaggcataaaataataatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggggtgatgatcggactgaccgctgtttcattcgcatcgggaattttaaattcattctactccgcccacatcagccagagctatgcgtatgatacgcgaaaagggctttttcaaaaaattcaatccttctcttattcgacgtttgcgcaattctcatctacgtcgtttatcaccaggctgacaaacgatgtgacgcaggtccagaatatgcttttcatgagtctccggtttatgctcagggcgccgttaatgattgcggggggcattattctctcgctgaccgtcaatgcgaaactcgggttttttctgctgatcacggtgccggttttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtttccgcttttcgtctcgtggaagcggcgatgccgattttaatgctgctgatgaacagctgcattttgtttatcttatggttcggcgccaaaagcattgctcagggcggagcgcaggtcggcgatgtcgtttctgtcattaactatgcgacgcggattacaggcgcgctgtccgtcctgccatttctcattatggtattttcccgggcgaaggcttccggggaaagaatcggcgaggtgctggaaacagaaggcggcgagggaacggggcacgatccggcgcgggcgctagcaggcgggattgagtttcgcgaagtgtccttccgctatccggacatggaaaaagacgcgctgcatcacgtgtccttttcagccagcccgaaagaaacggttgccattatgggcgcgacaggttcagggaaatcaacgctttttcagctgattccgcgcctgtacacggctgattcaggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggatgcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaagccgtccctcctgctgttagatgacagtacgagcgcgctcgatcttcaaacggaagcgaagcttttacaagcgatcagatcctatgaatgcacgacactgattattacgcagaaaataaccaccgcgatgaaggctgacaccatcttattgcttgaagacggcgaattgctggcaaaaggcacgcacaaagagctgatggcacagtctcatctgtaccggcagatttatgaatcacaattcggaaaggagggagctgacagtggagaaagacattcgtaaacctttccgatatccgaaaataccgctcaaatcaaatgaaggcggcagaaaacgcgcgaaagcaaaagatacaaaaggcacgctgcgcagaatctggtcgtatgtagccgagaaaaaagggcttttaacccttgtgatcatcatggtagtcataagcgccatattcggcctgctcggaccgttcgtcatcgggaaagcaattgatcattttatcgtcggacggacgacggacggattggcgggggtgctgttcatactgtttgggatttacctcgtgcaatcattgtccttatggtttcaaaactattggatgatcaatatctcgcaaagcaccgtgtttaaaatgcggagcgagctgttcacccatctgcatgagctgccgataccgttttttgataaacagcgcctcggcgatttgatgagccgggttaccaatgatatcgaaaatgtcagctccactttaaatacatccgtcattcaagtgctgtcgagcgtcattacattcgtcggcacaatcgccgtcatgctgttcatgagcccgcttttaacattgatcacgcttttgattattccgatcatgcttttgagcattaaatggatcaccaaccggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcaggcttttgggcgcagacaatttcgggattcattccgaaagtcatgaactctttaaacaatttaagctttacgattatagcggcggtcggcgggctgtttgcgctgaaggggtggatttcgatcggttccattgtcgtattcgcagaatactcgcggcagttcacgcgccctttaaatgatttggcgaaccagttcaatacgatgttatcggccatcgccggggctgagcgggtgtttgacgtgctggatgaaaaagaggagcgggaagatgaagagcatgcgacgcaccagccgatcaaaacgggagagattgaattccgagatgtctccttcggctatcaggaagacagcccgatcttaaaacatctgtccttcagcgttccgaaaggacagtcaatcgccttcgtcggaccgaccggagcgggtaaaacaaccgttacgagcctgatcgcccgtttttacgagcccaataacggaaaaatcctcattgacggaacggacatcaaaaaactgacgaggtccagtctgagaaaaaacatggggtttgtcctgcaggattcctttctctttcagggcaccatcagggaaaatatccgttacggccgtctggatgcatctgatcaagaggtggaggcagccgcaaaagccgccaatgcccacggattcatcgaacggctcccgaaaggctacgataccgtccttacccaaaacggcgcgggcatcagccaaggacaaaaacagcttatttccatcgcgagagctgtgctggcggatccggtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaacttctcagccagaacgggttttaccgggaattatatgagagccagttccgggaatcataggtagggaaaaagacctccgacagagtgcggaggtcttttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctacgtcatcgcgacgattgagcttgtcggcggggtactgatctttttcggtttggcgacgcgcattatcggcgttctgtttgccgtcacattagtcggcgccatcttcacggcgaagctttcctcaccatttatgggcggatcggaatttgatttcatcttactggttgcgtcaattcacttagcgctttcaggaagccgtctgctttcattggatcagctccttttcaaatcaaaaaagggagaaactttttcagcataagaaagaaggcgttcaaatgaccggcattcatcaagatacagcaatcggttatgtcaaattgacgattaaaaatatggaacgctcgctcggcttttatcggaatgtcatcggccttcaagtcatctcgcagacagatcgttctgcagaactgtcagcagacggaaaacgcgtcctgctggtgcttgaagaaaatccgagcgccgtcgttctcccggagcggtctgtcaccggcctttaccatttcgcgatacttctgcctgaccggaaagaactcggcatcgcattggccaggctgattgaaaacggcatcgcgctcgggcagggggatcacgcagtcagtgaggctctttacttgtctgatccggacggcaacggcattgaaatatacgccgatcgtccccgcagcacgtggcgccgggatgcagagggcaattacgtcatgcaaacggcgcccgtcgatgtggacgggcttttggaagaagccggagctgaacggaaaagccgtctcccggaaggaaccgttatcggccacatccatcttcatgtgacggatttacaggaagccaaagcgttttacaccgatatcctcggttttgacattgtcggcaattacgcgggcatgtccgctctgtttgtttcggcgggagggtatcaccatcacatcggtctgaatatatgggccggaaaacatgcgccgccgaaaccgggaaatgcaagcgggctggattattacaccatcacgctgccgcatcaaaaagagctgtcacgtgtgacaaaagcgctgaccgatgccggctttgagatcgaagaaagagaagagggcgtattcgtcaaagaccctgtatcaggggcggatatcgcatttacactgtaagaaacaacccttgccgtctaaccggcaagggtttttatttttctaaaggctcgggaaagaagaacgtcgatttgcaatatacactcggcttttgtgtgactgaagagagcgaacatctcagtgaggcgcaaacatgacgcgtggagcccgccatcgccggcccgaactcagggcatccgctggattgaaaatgggtgtccgttcggcggatcagggagctgtatgggcagactttgaatagaaaaagggaagagccgcatccggtcacaagatgcggcttttcatatacaatttacaattgtgtgaaaaatgcccaaaataaattgtgcttcctgattcttcctgatatgataagccgaaaaaggagaacctccacaaatgaattcaaatgcagcacagacggaacagtctatgaagcataacggaaaccggatgacgttcaaggactttatcattcttgccaaaccggggattatcatctcaaattcactcgccgcattgggcggattttggatcgcgtggcttcagccggaaaggacgggcggagggcccggtatatttgccgccatggcggctgccatgatcggaacggcgttagtcatggcgtcaagcactgtttttaataacttctttgaccgcggcatggacgcaaagatggcgcgaacccgcacccgcgccagcgtcacgggaagaataccgccgacggtcatgatcctgtacggcacatgtctcggcgcatgcggattcatcatgcttgcttcgcttaatgtactgaccgccgttcttggcctgcttgcatttttgctgtatgccgtcgtttatacgctttggtttaaaagacaatccgtctggagcacatttgtcggcagctttccgggggcggctccgcctttaatcggttattgcgcgctggccgggtacattgatatgcccgcgattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttttgactgcggtttcgctgctcgttcctctttatatagacgtcagcccgttttataccgcgtccgctctcctgctcggggccatctggctgtaccggagcgtcaaaggctttcaggcggcggatgacacgcaatggtcgaaggggatgtttttttattcgattgtttatttcagtctgctttttcttattttaatggctgattcgtttatcaatgcggttctcagaacgtaaacaggcggcctgcagatacagagccgccccgttttgtttatgcttttttgatgagagccaaaatatcttcaagccaggaaatataattccgttcccgctcaagcgcttttgtcagcacgagataatggccgaaatcaggagaagaaaatgaatccgcctccgccgacgatgtcatcagttcttgataactgttttccagatcggacaatttctcctgccgctttacgagctgatcggtgaatagctcatccgcttcttcctgcgtcaaagctgagatgaaataagccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgctcaaaaacgcagaagcgccggatgcttgtcattgaatccgcggcgccaaaatcagcaaaaatatgcagcaaggggttatcgaaacggcagcagaactggaaaaagcctttatcgtgtctatgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgacttatacgccgatcaatttgatcccgtgctgaagtacggcggcgaaaaaaagcgctctgacatgaaccgggacgctgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctacgggcagagacggcacaggtcttttatacggcggactccccgggctggtacttaaagtggttccggaaaaactcggactggattacgctgaaaaaaagcattctgcaattttgcggcattcaaaaagccgagcggaaccttttttctgtcgtcagaacgagcacccccgaactgcgggaaaaatggctgcgccaagcatacgccaaagtccggcgcgcttgtgaaaaaggagcggccgcatgcagataaaagaaattttcgtgattcgctgcctgtcctgtttaagtgtcgttctgcttcacgcagtttcaatggtgctgatgattcaggaagagtccttagccagtgccgcccatacggttgatgcatttcggaccctgttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcaccgctggctgaacaacacatcccccgtgggggtgctgtctgtttcgtttatcatcaacgccgtctatctggcttacttttccatctttcatccgccggcatcatcggggcttgattctatttttccgttcttttgggttccgtttccgggctgggtattttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccatccttcttttatttttgatctgcacgctcggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgcttcggccgcctttttgatacgggtccgctttatccggcacgaggacggatagttgtacatcctgcatacaaagcccccgcctgcggctgttttgacggatgcatttatgacaaaataacgccatcgattttctcccttgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagagtaaaagcgtacagcgccgttcagggaatggaagatgagcatgaaatcgcaatcgtcatccagctgatgataccgtctgagatatccggagtgctgtttaccgcagatccaattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaaacatgtcctcctacttggacgaatcaccggagtggtgccggaatattgaggaaaagctgaaacgcgccgaaacggagcaggcattattagcgatatggaacgatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccagggccaccgtggcccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatattagagaaacaaccagatccgaatttgtcagagtgtaccggacagccagagcattcgcgctcagagcggcggaaatgaccggcatgaaggacgatattttcttcctgtatctgcatgaaataaccgatctgctcgcggggaaagagccggcggttgcgtcgattcaagcgagaaagcaaaactatgaaacctataaaaaactgccgccgtttccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgctccggaagacggggattcttttgcggcgggggaaattttagtgacgtcgacaaccaatgtaggctggaccccgctttttccaagagcggctgccatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggcatcgtccagctggaaccgcggcagactccggtcacttctgaagaggaaaatggtaaactgatagaatagaatcatgagaaaggagccgcgcatgaataaagcagttattaacggggagcaaatcagaagtatgagcgacctgcaccagacattgaaaaaggaacttgcccttcctgagtactacggtgaaaaccttgacgctttatgggactgtctgaccggatgggtggagtaccctcttgttttagaatggagacagtttgaacaaagcaagcagcttacagaaaatggcgccgagagtgtgcttgaggtctttcgtgaagcgaaagcggaaggctgcgacatcaccatcatactttcataatacgagcagcgggagagagacaaaaatggaaaaacaaaccctcagctatccgatcggagagtatcagccggctgaatcgatttcggccggacagaaacaagaatggatcaatgcgctggaacacgctccggctaaactgaaccaagctgtcagagcgatgtcggccagtcagcttgatacgccgtaccgcaaagggggatggactgtccgccaagtggttcaccatctggcggacagccacatgaacggctatacccggtttaaattgagcttaacggagaatgaaccggaaatccgtccttatgatgaaaaaggctgggccgctcttcatgattccaaaacagccgcttgcggggatgcgcttgagctgttaacgatcctgcacagaagatgggccgctcttttgcgctccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctatcttagaggatgccggcttccggaaaaacgccaaaacagccgcagacacaatcgtgcataatgaaatgacggcggctgccgtataaagatggtggtagccgctggaaatgcccgcttcaatcgcctcagaaaccgcttttttgacggcgggaacggggattcggcttacctgctcctgcaacgaagaaagtccgccgccgatatcgggcgtttgcgcctgatcagcgggaatgccgcttttcgttaaacggtttttaatgtcctctccgatccggtcaaagcccgctgtaatgaagccggcatataaagccggagcgagcgtcagcccgacctgccttacgagtgacagcgtgccgagcgctgttcctttgttttggcccgccgtttctgatacaagcacattcagcggagccccgagcagaaatccgaaaccgatccccgcaatgacactcgccgtgacaaattcccatttatccgtcacccataacggaaacaggctgaagcccgcaaaggcgatggcgcctgatacaaccgcggagaagaccggtccttttttatccgtgaccgccccgccgagccacgctccgatgcctgacgccaacgcaagcggcgtcatccaataacccgctttctccgccgatacgtgcaaatattgctccgcataagaaggaataaaaatgaccgcagcgagcagccctcccgataaaaatccgatgacaagcgtccattgaaacactttattttgcagcagcgagtaggcgagaatcggatcgcccccccggttttcaacccgcttttcgaccttaagcagcaccagaaagagaagtgccgctcccaaaagatacccgtacacctttacgtccattatgctttctgacagcttcgccccatcgagattcgtgataccgatcatacaagataagatcgcaagagacagcagcattgtgccggcgaggtcaagccgtttcgcctcaggctctttcgtttcagcgataaacaaaccgccgcacacaaccaaagcggcggcaatcggcaggttaatcaagaacagccaatgccacgatccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacaggccgacttccatcataaacagttttttccgcccgtatcggtccgacagcttgccgacaatcggcacactgacactgagtcccaatgtgtaaagggtcactccccatgatccccatgaaggagaaacatcaaaagagctgttaatcgtcgtcagagcagcggaaataattccgttgtccagcgccgccatgaacacaccgatcgtaaaaagagtgatggcccggctctggtttttttctgtttgcaatggatccggcatactgatcaatccttccttttttaattcacttcgaatatattattcacttagagtgaattaaatgtcaaacaaaaaaaggccgccgataccggcaggcctttttcatctctatgcctgtttggaagaatcaagggctcttgccaagatggcaagtccttgattgaccgtttgtttttcttcagcggtcagcgtttccaatgaacgcttcaattttacatgtcctttttgataaaggctgcggaaaatatcttttgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagtatccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatcgatattaaaagtattatttcctattgcagttttgcttttagtcatttatcagtccaaaaaggaattgacagacctttcttttaaacgaacgctgtatattattaacgggattgagcgttacgatttatttattctcgttctgctcggtctccttgccgtcagcgcgatgtccttttatgactttgtgctgaaacggacgcttcgcctcgacattccgaattggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgctgctcgggctgtccgtcttcagtatcctgacgattgcccgcattctgccggtcggagagattacaggtgagaaaccgtggctgtgggctgtaatcgccggagtggcgcttattgtgccggcagccttaatcgccgcttggatcaacaataaaaaagctcgcgcagaagacggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccgggaggattcggttcgtttgaccttctgtttctgctcggtatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttggttttcatggcgggagtcgttgtgctggcgtccgttgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgctgcgctggtcggcggttttgtgttcagtttcttaaaaggattgaacatcagcgcgatctttattctgcctgtcgtcatcgtattgctggtgctgttaaagcggcagtttatcagagagcaggcatcgtatacgctcggccagatgatttttgccgccgctctgtttattatcgccttgtttaactacaatctcattgccggctttatttgggataaaatgaatcggctgctgcgccacgattatttcgttcataacaattcgcacattacatatgccacgatgacggccattattgttgtgccgctgtttttccttttgtttacggtcttttatcataaaagatcgaagccgatcggagaaaaggccgatcctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaacaacaaatttgaccgcgaaggctacacatttcatgtcggggaaccgccgttttcctccgagtttatcgccaagctgaaagacatatcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacggtattatggatgcgcttttcatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgtaaaaacagatcgctgtccgtcacgatgattctcgtcacccgcctgatcggaaaaaccaaaaaaagacgccgttaaaaggcgtcttttttttgaagaattaactaaaaattctaattttactctgttatactgaataacatgatcataaggtgaaaggaaggctgatgaatgaaacaggcaaccgtgtttaaatatgaagcgtttaccgatattcctgatttgggaaatcccgcgggaatcgtctttaacggagatgattattcagatgaagagatgcagatgatcgccgaaatggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggtattcttcccgcaaaagccgctgaacgaaacggccgggtatacatcacgctcgaacaggcacccccgcaatttctgccgtttacgggagacaaagaaaagcttgcggcctcgctcgggattacagctgaggattttcacagcgagctgccgattgtttacggatcaacggggatctggacactgattgttccgctgagatcacttcaagcatcacggaatatggtgccggaaaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgaggcaatacggaggctctgaagccgaatgcctcacgattgaacaaggccacgaaatcgggaaagacggaaaagtggaaatcaggattacagaagataacgaaaagatgaaaatcgagatgacgggaacggccgtgtatgccgaatcaatcaattttcagcttccgtaacggtttacaagagacggtcgtatccgttatattataaatgataatcattttcaattgaataggaaggtgaatcggcatgccgaaaaccgaacaactacagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatctacgcagcaagcgaagcgggaaaagcgaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggtctggcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggtcccgatctttattcagtttatttccgtttggctgctctttccgcttttttgaattcaccggaataaaggacttcctgcatttttttcagattggctccctgctgatgtttttcgcgcttcttttccataaaagaagaccctccttcaaaacagaataccaataggattggcttttatttccgtttttatgcagataagatatcctttaaagccaactcaagttcttcatacgtaaattgaaaaccggatctcagcgcctgcttaggcagggcgcgctggccttttacgatcagcaggctcatttctcccaaggccttctccagaaaaaattccggtacgggaatccaatgggggcggtgcaggacgcttgcgatcgtctttccgaattgcttcatttctacgggattcggcgatgtcacattcatgggaccggacaagtcatcatgctccgccgcaaaagcaataagttccgcggcgtcatcgacatgaacccatgacagccattgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgacggcgcttgcctgaatcaaagcccggggttttttcggctgctgcttcataatccgtctgacttctctcgtcgcttctattctgcttgaaatgatttgttccttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgccaaaaagaaaaacgcctgaacatcggggcggggaaggagaccgggatgccgtttattacaaaaatatcgacccaaaagaaaaataccgagcgcttcaacatctttcttgatgagaaatatgcattcagcgtcgacgccgacgtgcttgtgcgttttgacctgaaaaaagggaaagaactggacgagcttgacattcttgaaatccagcacggtgatgacgtgaaaaaagcctttaaccgcgccgttgaatttttatcatatcggatgcggtctgaaaaagaagtccgggatcacctgaagaaaaaagaaacaccggacatggtcatttctgaagtcatccataaactgtacgattaccgctacttaaatgacaaagaatttgccgaagcctatgcgagcacccacaaaaaaacaaacggcaaaggccctgacgtcctgttccgcgagctgaaagcgaaaggaatagacgacgataccatcaaggagacgctcagcgcgtttacatttgatgagcagatacaagaagcgctgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcgattgacgatattgatcaattcttgcaggaagaggagtaaactgaaatggacaaacgatacagtcaaatgacgcctcatgaactacagacagaaattgcgggactgacggaaaaagcgcgtaaagcggaacagatgggcattgtaaatgaactggccgtgcttgaacggaaaattacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcaacctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgttatgggtattctgacgtcgattgccgatgactttcatatacatgtatcttcagcgggcatgcttgttacggcgtacgcggcaagcgtctgcctgacgggcccgatcgtaactattatcgcggttaagctgccgagaaagccggtgctgctagggttgatgggcatcttcgtgcttgccaacctgatgagcgtctttgcgccgaacttcgccgtgctggcgatttccagaattttatccgcatccattcacggagctttttttgcgatcgccatggtgtttgcaagtgaaatggtgccgcctgaaaaacgttccgccgccgcggcttccatgaacggcggattaaccgtggcgctgatgctcggcgttccgttcggctcttatttaggggatgcccttaactggcgggccgtctttttcattatttctgttttaggcctgatcgggctgatcggactgatgctggtcgtaccgaaccgaaaaccgaaagtgattccgatgctgatgaatgaatggagtgtctttaagcataaacaagtgattttttcctttgcgatcaccattctcggctactcaggcgtctttatcgcttacacgtttattgagccgattttaagagattcagcggggttcggcacagtcggcattacaggcgcattatttgcctacggtctcggcggagtggcggggaatttcttcgcggggaaagtgccgctcaaactgctgacgcgcacgatgatcggtgtgatgatcggcctgatcggcgtcttggcgatttttccttatatcgctgtttttcccgccgcagccgtttcagcgacatttttgttcggcgcatgtgcgttcggcacgccgccgcttttgcagaccaaggttatttcctcctctgaaaacggcacgacaatcgccgctgcggtgagcgtttccgcctttaacctggcaaacgcgctcggcgcctggatcggcggattgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcaatgtttcaacgtaatgctgatcaccgtatgtttatcgctctcagctaaggaaatattccgggtttccggtaccccgtctttttcaaaaacaacggcataggttcctttcgcgccgcttttccatgtcatctcgccgtggtgatcagtcttgcctattatctctccgcggtctatattcggctgatgatctgactccgccgctttcatcacggtaaccgtcacaccggccgccggtgaaccgtctgcattctcaacatggagcgtaacgggcagtgcttttttggcggcggaatcatccgctttgccgcatccgcataaaacggctgccgcgagaaagaagacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggataccctgtcacggttgaggaaagcccggccggactggaactgttggtcgtccgatagccgtaccagccgacagtattcccgggcgacccgtttactttgattgcgccgtagtcatagtttgtgtcaccgttttctgtccaccctttgacactgtagaaggtcttgcctgaataagagccgtacgggtacgatgacccgttgcggccgggagctgccgtaattttcgatgcccagccgtttttctgatcatacacgcaatgtcccgccgtaacgatcgtgtcggcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggagatgtctgtgttgtttgtacaggctgattctgatttgcgtcaaactcctcaccgctgtttgatacagatgtctgcgggctgcccgctgcttctgctgaaacagcaaataatgaaactgacagtaagaatgcggtaaggctcagcaatcgttttgaaactgtcttcattttataaaacccctccttttttgtctaccggcttgcggtttaacatttaacatattatggaatttatttagcgttatgaccgcaagaggatgtttttttccgcaaaaaaaagaccgggtcattcccggtctcttacggtgtgtgttatcgtctgcctgaagctctcatgcgctcttgcgggtgcgaattaattgaaccgtccgcccgtttagaagcgtagtcatcctttgcccgcggttcgccttcaaacttattattgttctgattaggaaatccttttgccttgttccggaccatttgttttccccctcggccaatatcaaaaggttgcgccttctggactgaagacgtaaagttagtatatgcctgtgacaagctgcgtaaaagcagcaggttttcccaaggaaaggagacagagacatgaatacatatatcgacaaactgacgaatttgctgcttgagaaaaatgacatgctcagctatttgcaagcgcggacttgggttgagcttttatggggagatttcgaagcgacttacgcaaaagccggccgcccgtaccaaggagagcaaatgacggaacgcgtcgtcaaggaatggatcgaatcatacggcagcaagctccatatgttccaaagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcatcagacaaaaatagacaccgcagcagatacatatatcgtgaaagcaggagaacttaacgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagggtctgttaaagcgggtgaaaccgtcaatgtgctcggctgggggttcagccatgacggaggatttgaccgtaaatgggcgtacgtcacatacgccgggaaagcaggttatgtaaaaacggccgacttaactcaaaagtaaagattcaggcgggcgaataagcctgctttttttctgaaacctttcgcctttcctttcgtaaaagatgaaaaggagagtgacggatatgataatggtaatcggcggccttctgatggctgcggccggcatttcagtcacgttttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggatttgcgggcagcctgcttatccggctgactcagccgttcgccctgatcgttcaggccgtattgttgatcgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctttggcggtgctgctgcacgggtttccggaattctggtacggctggaagagtcagatcaaaccgctggcggatgccggataccatgttgtcgtgcctgatcagcgcggctataatctcagtggcaaaccggagggcattgaaaactataccattgatacgctcagagacgacattatcgggctgatcactcattttacagatgacaaagccgtcgtcatcggacatgattggggaggagccgtggcctggcatttggcatccacgcggccgcaatacgttgaaaaattgatcacggtcaatatcccgcacccggcggttatgcggaaggtcacaccgttctacccgccgcagtggaagaaaagctcttatatcgctttctttcagcttccggaaaagccggaacggagattgtctgaagacgattaccgcgtattggatcacgcgatcggcttatctgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttccgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaatcatatgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattttggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgcccttttgaagctgagtgaagggaaccgtttctcgaaagggctgttctgctggatcgggtttgaccagaaaatcgtattttatgaaaatgtcgaaaggaagaacggcacgtccaaatggtcattcagcaatctgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgcagtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggcttcggcagccgctcatatttttttcttaaaagagtggtcggcaggccgctatatgacggggtctggagacgggatcgcccaaatggcggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcagcgtgtgtgttccgctatttcgtcaaacggacggtgcctgcttttgccggcgccgtgttgtacggagtctcgattatctacttccggcatgaggtgtattgggactttttcactgacagtatggtgtggctgccgctgctcgtgctcggcgcggaaaaaatcatcagggaaaaaaagccggcgtggtttatcttcgcctgtgcgctgacattgatcaacaacttttattttgcgtatattaatctgattttcatcggcatttatatcttattcaggtggatgatcccccttgaaggcaatgaggcgaaaaggctcactcaatgcaggatatttattctgtcgggccttctcgggttcggcataagcgcagtttcctttattcctgtcgtatacggttaccttcataatctgcggccgccgtattcagagcatattgcatggcttgatttttccgacaacattttattttcaagccggataatcattctgccggcggtttttttactttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgccgtactcgccgttctgctctattggagccaagtgagacggttcagcctggatatttctgatcaggccaacctgcctatcctgctccttctggggctgaccattgccgctttccttgcagcaaagacaagactgaagggcgcggtgcccgccgtctatgccgtcattctcttgacggcggtgctgacggctaatacatatgaaaaatatgcgttatcagaaggcgggaagatttatacggtatcgcatacatttatgacgggtcctgactataagggcaaagaacaaacagagcttattcagcgtctgaaagaaaaagaccctgatccgtttgcccgcttagattggatgaacggtgttttcaataacaccccgatcatttacgggttcaacggattcagcgtatactcaagcatcctgaaccgcaatctgctgtccttttactggaacgatctccggattgatatgggcagagaaagcgtcagccgttatgcgacattaggaaacagggctaatttatacagcctgctttacggaaaatattatatgacggaaaaaacaaacggggccggcgtgccgtacgggttcaaaaaaatcatggaatcatcccattatgcggtttatcaaaatcaatatatgcttccgttcgtacggacagctgatcgcgtatataacgaggacgatctgaaaaaagcgcccgcccttgccagagaacgggcaatgcttgacgggatcatcacggaatcaagcgcagccaacacgaaaaaagcgcctgaggcgaaaaatatgatccgtcaggcaaaggtaacggccgaccatgcggattatcaagacggcatcctgacggtaaacgaagacggcggcctgatcattacgccgcaagccgctaagatggacggcggcgattattacgtcagcttttatttgaagaataaagcgaaggaccagggctttacattaaaagtgaacgattacacgacaacgagaaaatcgaatcgatccatttacaaaacaggtgtcaacgatcttactgtcagagtgccgaaaacaaaaaacatccaaatccgtctgccgaaaggatcgtatcagcttgacaggctggcgctttacgaagaacggtacgatacgctgaaaaacgcataccgaaaagcggaaaaagaaccgcgggccgatctcagatggcgcggaaatacgcttcatatctcgtatgaaaacaaaaccagcgcgccgtatatcatgcttccgattccatatgaaaaaggctgggaactgaagataaacggcagaaaagagcagattgaaaaagcggattattccttcatcggatttaaagcacaaaaaggaaaaaacgatattcaattaacgtattacccgccgttttttaaacccgcggccgctctatcggtgatcagcctcgtgtttgccgcattatatgtgagaagacaaaaaaagcccggctcttaaacagagccgagctttaattttttctgcagtttttcctcgctgaaaatccagcccgtgtaggaagagagaagctctaaatcatgactgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcacgcggttgaatgtatccaatatcacgacatggccgtcaaggcttctgccgacataaaaggcatgcgccgtcgtcacggcgatacgccattgcctgaatttcatcgtcggcgaaataatgatggtttcaatctcctcttcaatcatttcgcgcagccttcgctttatccgcagctgcatcaaaaaccggacggcgtaatatcctgcaaggatgatataaagcatcagaaatgtcacgcccggatgacctccgatataccaaacggcaatcgcggccaaatggctgacgaaaataaacggatcaaaggtattgattaaaccgagagcgatccattttctcgaaaacggacggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacatgggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtgtcagaggtgatgctgcagcagacgcgcgtagataccgtcattccttatttccggcggtttgttgagcaatttccgaccgtttcggcgctcgctgaagccgatgaggaaaaagtgctcaaagcctgggaagggctaggttattactcccgtgtaagaaatctgcaaagtgccgtaaaagaagtacatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcgccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaacaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaaaagcgtcagtcatagctgacgctagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgtccatatcacgtccgacatacatataaaagacccctttcaacagatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgttattaaagctaatgtcggccagccggcaaaaatcaaagacatgttccgccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagattaaagatatgatcgacacggtggagtttttagtttcttcaaaagcggacatgatccgcggccagaccatcattattgacggcggacgctctctgctcgtataagttttaaaaaaagatgaatagccttatcgtctcctgcgcattctaaagtgcgtggaggtgataacaatggcaaactcaaaatacagcaaaacagacgttcagcaggtgaaaagacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgctaaaacgacaaaacttgtgattcctctacagaatgagtcaaagggttttccggcgtaaaatcgaaatggtaaggagtatcaacctaaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagccaacgaccggacaatggtgacggaatccgacggacggacgtgggtgacgagagagccggcgatctgctactttcatgcccgtcagtggtttaacgtcatcggaatgctgagagatgacggggtacactattattgcaacatcagctcgccgttcgcttatgacggagaggccatcaaatatattgattacgatttggatgtcaaggtgtttccggatatgacgtataacattcttgacgaggatgaatacgatgaccaccgcaaatcaatgaattaccctaaagagatcgacagcattctgaaggagtatctgaatacgctgctgcattggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagagggggataaagtgtgggcgtaatcagacgctatatgcaatttgtaaaaccttataaaaaacaaatttttatcacagtgttaatcggcattataaaattctccatcccgctggctctcccgcttctgttaaaatacgtggtcgatgacattattcaagggagcggaacggcaagcgctaaaacatcatcactattcacgataatgggcatcatgttcgtgctgtttttaattctgcgtcccccggtagagtactatcggcaatacttcgcgcaatggacgggcagccgggtgctctacgatatcaggggggtattgtttgatcatattcaaaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtgaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcagttgtgaataccattacggatttggcgccgctgcttgttatcgcgtttgcgggttattttgtcataaacggcccgcttacggtagggacgatggttgcgttcgtcggctatattgacagaatgtacaatccggtcagaagattgatcaactcatcgacgacgctgacccagtcgatcgcttcaatggaccgcatatttgaatttatcgacgagccgtatgaactgactgataaaccgaatgcactaaaagctgacggcattaagggtgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcgcagatattcgcgattatgaagcgagaagcctccgcaatcaagtcggaatggtgcttcaggatacgtttctgttcagtgagacgattcgtgaaaatatcgctatcggtaaaccgggagcgtctctggatgaggtggttgcggctgcgaaagcggcaaatgcccatgaatttattatgaacttacccgaaggctacgaaaccaaagtcggcgaacggggcgtcaaattgtcaggcgggcagaagcagcggatttcgatcgcccgtgtattcttaaaaaatccgccgctgctgatcttggatgaagcgacatcggctcttgatcttgaaagtgaacactacattcaggaagcgatggaaaagcttgcgaaaaaccggacgacttttatcgtcgcccacaggctgtccacgattacgcacgcggataaaattgtcgtcatggaaaacggcgccgtcgtcgaaaccggcacgcacgaggaattaatggcccgaggcggccagtacagacacttatttacgattcagaatttgaactgatacaaaaacgtatgccgtccgaatggtcggcatacgtttttttgaatgcaaaaaaacccggttttacggaagcaccgggttactcttcgtctgtttctaattcgctgtctttcgggtggtatgtctgaaaactcgtaattagtgtatcgagatgctccagctgctcgcggtattccgcaaccgcagccataatgctgagcatattgtaatcaagcagttcatcctcgcagttctgctgatttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatctcgttttcatagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtagactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagaagttattttttcatatgtctgaacgcatcttcaacggcttgtaaagtggcgtcgatatcctcttcagtatgtgcggttgtgataaaccaagcttcatacttcgacggagcgagattgatgccgcgttcaagcatcagcttgaagaacttggcgaatgcttctccgtccgtattttccgcctgctcgtaattgacgattttttcatcagtgaagtaaaccgtgagcgcgccttttaaacggttgacggtgatggtaatgccatgtgtctccgcatgggcgagaatgccttgctcaagtctggcgccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaattcatttacctgttctaaaaatccttcttcaggttcaacgatgccgaagttgccgacgatcggctcgacgagaaccgctgcaatttctgaaccccatttatccagcgcggctttgtagctttcaatatcattgaaaggaacggtaatgacctcattggcgatgcttttcggcacgccggcggaatcaggggtgccgagcgtagacgggccggaacccgcagcgacaagtacgagatcagaatggccgtgatagcagccggcgaatttaatgatttttgtgcggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttccgccgctgttttaatcgcttcagtaatatgcggatgggcatgtccggtaataatcggaccgtaagccgctaaataatcgatatactgattcccgtctacatcccagaaataagcgccgttcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacgggttcatgcttccagaaaagagccgggggataacggttgtaatcttaacgtgaattggatacgcttaataaaaaacccggaggtataagaaatgacgattgaaatcggacaaacagcaccggatatgaaattagtgaatgacagcggggaagaagtagcattgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgccgaggcgcttcgtgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgctttgccttccaatcctttatccaatgtaagcggctctctgcaatgcatgcacatatccactctgcccagaatcttcgtttctttctcgcaagcggggcacatcacccggaccgcttttgtggacagcatgccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatccccctctcgtttaactatagcacaaaacatatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtcaaacaggctgatgaacctctttttataaagcattatgaattcgaacacaaaaccgcttctttacatattgtaacggatgctctgcttcaggaatggattctgcttgggacaaatagaagagtcatagattggatcatcaacggcaaagtgctgtttgaccgcaatgaatatatttctgaactcaatgaccggctcagcacttttcctttcgccgagcggaaattaaagatcggaatggaatacggcaagctgatcagaagatttgtagaaggaaaagcgttttttgaagctgatcattttctggatgcatattatgcagtagtgcacgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggctcgaattattattcttagcaaatgattttctcatccattcaaaagctgaaatcggttctgcgcacctttttcaggtgatgaaagaaaaagaaatgtggcagtttggagaattgcttcagcaccctgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgc

SEQ ID NO: 122 - DNA, 79181 bp, Bacillus velezensis FL50S
taaccgcttgaccaacgggccataaaaagtggtgagccatgaaggactcgaaccttcgaccctctgattaaaagtcagatgctctaccaactgagctaatggctcttgatgtgtcggattatgtatcatagagcattgagacaaaagctttcttgcagtactctattgaagctgttccgtaacaacgagatttataatatcatagaacattcgaaagtggcaactacttttttgaaaaaaatctattatttttttcctacataaaaaaacaagcctccgtgaccggaggcttgtttgctgcaaattcttagttagcgcggtatacactgcggatgacgttcgtttgtgaacgatcgggaccgacagagaaaatagaaagcggaatacctgtcagctgagatacgcgttccagataatggcgcgcattttcaggaagatcgcttaatgtttttgcgcctgtgatatcttccgtccagccaggcatttcttcatataccggttcacactctgcgagagctttcagacttgccgggaattcttcaatcacttcacctttgtagcggtaagcgacacagattttcaatgtttcaatgccagtcagcacatcgattgagttcagagaaagatctgtgattccgctgacacggcgggcatggcggacaacaacgctgtcaaaccagccgacacggcgcggacggcctgttgttgtgccgtattcgcgtccgacttcacggatttgatctccgatttcatctttcagctcagtcgggaaaggaccgtcaccgacacgggttgtgtacgctttagatacaccgacgacgtgctggatttttgtcggacctacgcctgaaccgatcgtcacccctccggcgaccgggttggatgaagtgacaaacgggtatgtcccttggtcaatatcaagcataaccccttgagcgccttcaaataaaacgcggcggccttcatccagcgcgtcattcagaacgacggatgtatcgcatacatactttttaatctgctggccgtattcataatactcatccagaatatcttcaattttgaagccttccgtttcatacattttttccagcagacggtttttctcttcaaggttccgttcaagcttttctgcaaacacgtcacgatctagcaggtctgcgatccggatgccgatccgcgccgctttgtccatataagcaggtccgatgccttttttcgttgtgccgatcttgttggcccctttgcgttcttcctctacttcatccagtttcagatggtatggaagaatgacgtgggctctgttgctgattctcaagttatccgtgctcacattgcgttcatgaagatacgcaagctccgttacgagcgctttcggatcaacaaccattccgttcccgatgacacacgctttttctttataaaaaattcctgatgggattaaatgaagcttgtacgtgacgccatcaaacttgatggtatgtcctgcattgtttccgccttgataacgtgcgatcacttctgcattttctgataggaaatctgtaattttaccttttccttcatcgccccactgcgtacctactacgactactgaagacatatatccgtgcacctccgttaacctttcaaaacgatatctcattcaaacaaattaagtgtatcagtgccgaaacagaaagtcaatcgtaaatccgaacattaaaatcttattattctatatttgttcgccttaaacctgattaaaagcgttttctctttcatttgctatctattactcccgaaactttcatactttaacacgaaaaagaacccatatcccgggttcttcagacagtcatttatattccgcttgtattcatcaggacgatccgccagccgtcaggatcttcgatggtcacgcctttttcttcccagtacgggttttcgggttctttctcctcatatcccatctgctttaatttcgtgctgatgcgaatgacctcctgctgatcagggacgtaaaagacaagcaggctgtcgccgtgcggaacgggcgccggatgagacgagccggtttcttcggtgaattctaaatgatattgcgtatgcggcaggccgaacatgacgccgctgtagccctcatgtccggaaaaactgccgaccctcttcaatccgaggccttcttcataaaacctgatgatttccttaagctgtccggtcggccgggcaatccggatttgcgccgcttgaaattgcggaaattcaattgtcatcatcatccctcccttaatgccattatataaaagcgctttctttttatcgactgccgaacagacggcattctctcattctttcggatgaaaaaaagcctcaagacattgcttgaggctttacgcacctgccggaacaccgccgtcatcaaagcgcctttccagatttacgaacttattgtattctttcacaaaagccagtgagacggtgcccaccgggccgttacgctgtttggcgataatgatttcgatgatgtttttgttttcggattctttatcatagtaatcatcacgatacaggaaggcgacgatgtcggcatcctgctcaatacttcccgactcacggatatctgacatcatcggacgtttatcctgccgctgctcaacaccccgggagagctgagacagggcgatgaccgggacttcgagctcccgcgccagcgcttttagcgcccgtgaaatttccgatacctcttgctgacggttgtcgctcgaacggccgcttccctgaatgagctgcaggtagtcaattaaaatcatgcccaatccgttctcctgcttcagccggcggcattttgaacggatttcgctgacgcggatgccgggggtgtcatctataaagataccgctgtttgacaggcttcccatcgccatcgtcagcttgccccaatcttcttccgtcagattacccgttctgagattttgggcattaatattcccttcggcgcagagcatacgcatgacaagctgctcggcacccatctcaagactgaatatcgcgacgctctcatccgttttggtagccacgttttgcgcaatatttaaggcaaacgccgttttccccacagacggacgggctgcgacaatgatcaaatcattccgctgaaaacccgccgtcatccggtcaagctcgataaagccggtcggaatcccggtaatatcgcctttccggttgtgaagctgctcaatgttgtcgtatgtttgaacaagcacgtctttaatattttggaaggcgcccgaattttttcgctgcgcgacctccataatcgttttttccgcatcgcttaataaatcttcaacttcatcctcgcgcgtatacccgtcttgagcgatcgaggtcgccgttctgattaaacggcggagaatggatttttcctcaacgattttcgcgtaatattctatattagccgctgtcggaacggaattcgcgatgtccgtcaggtaagagacgcctcccacctcttctaacaaatcggtattcgcaagctctgacgttaccgtgaccaaatcaaccggttcaccgcggtctccgagcacgagcatggcattgtaaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctttccttaaaaaatatccaaacttcattttaccatttctcatgaaaaagaatagaaaaatatcactttgcctgtatttgtcaggagagggttatgtgttttgccgttccgaatgccgggaaacaaataaataaatcgaaaccgggaggtaagaaggatgaaaacatatgcagtaacacccagtgttgatgcggacggatggtttgtgaaggtggaaaatgtggcgccgacggctctttgtacatcaaaggacgcggcgattgaaaaagcggagcagatggcgaaagagaacagcccggctaagcttgtcatttatgatcagcataaaaacattgaagaggaacgttccttttaagaaaagccttcgcccgtgcgagggcttttcttattcgatgaaacggatgtgcagcaccgtctgcgccatgagatcggccgttttttgatacagctcccattcttcaaaggcggcgaatactttcatcatgtcctgcaatgtctgtttcagtatgataaattcgtcaattgtccgcagttctgcggcttttttctgataatcagccagcttcagctgtaataacatcaatggcgattgcataaaaaacctcccccattctgttataaagccccgcttttcaaacctccattcctttgtcatatcctcttacgatagatttctgattttagtacaataaagaaacggaaggagtgatcacatgaaaccgctgcaaatttccgccgaaacggcgcaaaagctcgcagaatcactgaatatgccgcttgagagaatcatgcacatgcctcagcacattctgcttgccaaattagctgaaatccaaaaagagaacgatcacaaataaaggctgctctctcatatatatgtgcgggaggcggaagcgatggctttccgcctcttttttccatgaagaaaatttcggtaaaaccgtctcacagctgaaaaaacttgttgacgaaggaaaagtgaactatttcttgtaatcaggaaacaattcaggcaacacaaagcttgtctcatggattaaaaagaacggcacaaaaatctcacagcaccggaaaaacagctcggaaagaggctggatagttaaacaccggcctctttattttgctcttgaagcacctgccatgcggcgccggtatcattcagaaaaatgattgataaatcctttctatttttgaaaccatcagttcctgacgcagatgccggccggcataggagcgcgcttcttttccaagccgttccctgacagactgatccgtaatcagctttacgagggcatcagcaagttcgcggctgttgccgggctgacagataagccctgtgtcctcgtgccggatcatctcagggattcctccgcagtctgttgcgacaatggcttgacctgagaacatcgcttcgatgatcgctatggggaaattatcattcaatgtcggcaggacaaatatagatgattcagccaaaagcgccggcacatcatgtcgttttccgaggaaaaacacgtttgagaggcccagtttccgtctcttctcttccagaaaccctctcatgtttccgtctccaatgatccatatatccactccggataaatggtgccggatgcgggcgagagcgtccagcagcacatcatgtccttttcgctcggtcagacgggaaacgcacgcaatcacgaccttttcagcacgttttggctcgggtgcaacccggatgtcaatgccggtatgaacagtcgtcagctgagcctccttcgctccgtactccagcaagggctcgtgaaaggagtcgctgattgtaatgattttatccgaagcccgaataccctgcctttctatttcactgaaatatgcctcttctattgaacccttttggattttatgaaacttcatccggcttttcgtgaaatgtccgtgcggcgtgaaaaaaagcggacgccgatacgtttgattaaggtatcccagcaaaaatgccgcaaataaatcctgcgcgtgaaacaggtcatattgttctaagtccttctccttcaaaaatctttgaaagacatgtaaatagctgagattcttcacaaacttttcgtttgcggccccgtatctgccaacaagaaacgctctgatctcgtcagcggcccgcgggatatcttcctgaaaaaaagttggcggcatttggagcggcgagatgacatccgcctggtgaccgatgcgctcaaaacccgtcttaattgacgtgatataactcgccagtcctccgacattcgggtaacggagaaaggttgcgtacagaatacgcaatggcttttttcgtttgggggagctttttccttccgcacagaacgaatacagcatctccggctcactttgatgttcgatcccgtaaaattgatccatgacgcgcaataaggttagaggcaccagaccgttcggcttgccgatctctcctttcaaatccgctccccctctcttaaacttataatcctaattcccgtccccattttgacactttgtcaacatgatacggcagcagttctcctccccgattgtcgaagattctccgcaattgggtatgaagccctttctcaagtgttctctgcaaataagccattttataaagcgtcataggaggggtctgaaaatgaatgccccgctttttcatttctttcgtatacacttttacgcaatacgtccgaatatcttctgcgtgccggctccagtcttttctgaagccgagcagaatttcgaccagcaccgtcatatcaaaccaaaccggcgcgtactttgcggattcccaatcgatgaattgaatatcccacggttcatgtccggacgcatcgtgggtgcagatattctgcatatgaagatcaccgtgtgtgatggctgagccgttttggaccaattcagggaaaaaacccggctcctccctctccagcaagtttgtgatttgccgataatgaggcttcacgatatcttttgtgcgctcatctttaagagctctatccaataattccgctgtctttttgatctgctttttacgcccttttctcatggtttccgattcgtatagcggcagccacgaccgccatttaccgtcagaaacagtcttgttttcaaaggtgcggctgtgcagttctgcgacagacggaataatatacttgaaatgcttcggatgaaatgtaagctgtcctctgatctggctgacaaactccataaatatccacgtttcatggtcactttcctctataagatagatgtccggcagcaaatcccctaaaacagaacgggctttcccgtatatattaatctcgaccttatttttttcacgggaagatttatacaccttcaatatcagcggaacaattccggattttttctttacaaacagtttataaatggcgcttctgtctgttgatttcaggcatgtgatgtcatccggattcaccgcggccctttcaccgaacgaatacgacagtttttcgtcaattctcagtttttgaaatgcgtcatacaaaagatccttttcatacatgccgatcttccttccgcttccgtttccagctgtttttgagatgagaccaagtgtttctgataaatggcatcgggtcattccaagcaaaaagagcgtactctttttttcctttaaatcctttccaaaaatcccggaacgtcatttctcctctttttcgtttcttcaaaaacgttaagaagtaacgcacctcataaatccagttgattccgtctttttgttcgagctggggcttcacatgttgtccggtcaaatacagatagtacatgtaaacgaaatgaatgcctgccggttctgtcaggctatggctgagccaaaagcgcggattaatttcgataaacttataaacattgtcccgggggtcctttttaaattccgccatgcctactcccttcagctgaatcgcttcaaaaaacggcagggtcttctcgattaaatcaggaagccgtttgctgacgacgtgggcccccgcgccaaaatcagcagggaattgatggttcttttgcagagagaataagcccattaatttcatttggtcatcataaaaagtggcgactttataaaaacactggttgtctccggggatgatctcctgcacgagcagttctccattttctctgtaggagctgaactccttgcgcaattgtgcggcatccttcattacaattgcttttttgtttactttttttctgtattcatggccggccaccggttttaaaatacacgggaagtcaatattggcgatggcctcttccagctcatcccggttgttcggaaaaaaggttttcgggcaggggatgttatgcttgaccgctaattcatatgctttgcttttatctaagaccgtttctaacagagagcggctcgggagcaaaaataaaaaaaaaccggctaatgtctcgcggaatttagatataaatcccgcataatcatcagaacctgcatacagaaccggctttgcttggaatcgcttcccgaaatcagtcaggaatgtcagcagttcttcctcttgtgttaaagggctgggacatatcccgcaatctgccaatcttgattttccgatacgataaggtccctccgtgtcaaacgcgtaaacatcgattcctcttcgggccaggctgcgaatgatcccaatcccgtttgcactgaaatcaagtacaacggctgcatgttcatgtttcatgatctccctccgagctgttggtattttgataaatcgattcgatattttttaccatcgtctcactgctcaaatatttctccgcgtaggcctttgcgtttgaagcagctatcttccgcgcagatttgttagtgataaaaaacgctaaagcccgggcaagaacctttgcatttcccggctcgacaataagccccgttttgttatggcggatcagatccggaatacccccgcaatcggtcgcgatgatagccgagccgctgaacatcgcttcaataatcgaaataggcagactgtcattaacggtcggcagtacgaatatgtccgtcatattcaaaatagcgggaacatcatctctttttcctaaaaaggaaaccatagatagattcagttttcgagcctgttcctctaaggcgctcctcatctctccgtcgcccgcgatcagcacttgaacatgttcaagcacatcagacggaattcgtgaaagtgcgtcaagcaaatgattatgtccttttctcgggcctaatcttgcaatacacgagatgatgatcttatttttcggcagcgggatttttcttttcccgcctgtttttgcatcgtaatcgattcctgtgatcaccgttgtcatgtcttcctgttcggctccgagcttcatgagcgggctgcggaacgtatcgctgataataatcaggcgatctgcgtattcaatggctttcatctctagttttttataataaaattcttctatcgatccttttttaaagatgtgaaatttaagtctgttgaaagtaaacatgccatgcggtgtgaaaaataaaggtttcttatagatttgattgaatctgcctaatatattggctgtaaataaatcttgagcatgaaacacatcatatctttccaaatgaatcttttgaagcatttgctcgtatataaacatcagccgattatttttcaaaatatgattgttataatccccatatctgtccttaaagaaatcttttaacttcggaacaacagccgcccgcagttcttttacctgtgcggacggaaacagattaggggagatgacatcgaccttatgacctctctttttcaggccttcactaagcgttttaatatagtttgataaaccgcccgtgtgcgggtagtcccaaaacgtggcaatcaaaatggataacttcttttttttcctgtataaccgcggaatatgatgttcatgtttcaactgtgtctttactgccgcctttttttgagggcgcgttttgaccccgtagtagcggtcaagcgtctgaaccatatacggatacgggacggaaaatgtcttgatcatttccagatcctccgcacgacttcaaaagcttcagcgtattccacacccgccgtcatccctctgactcttcctaaatgtttaacgccttcatatgaacggggatgagggtaatccctcatttctacgtcatagtggtgaagcgccgcgagtttggcatccattgtgtctgtgatgttaacgaagtaattaggtttgaagagtttatcagccgtattcctctcccactcgcttgaagatagcgtttcgaacgtaagcagttcgataggcttttgattcggaagcggtctggcggctgttaaaactgcttggaatgttctctggtggtccatattgatatcgccgtaatgatgtgtaaagattttatcaggctgatagacgcgaatgagctgctctaattctttgacaagcttatgaagagggatacattccagctctaaattcgtatgctccaaaaagatgactttctcaattccaagctcttgattcgcgcgttcgcctaattgtttaatatgatgagcttcttcttttcttcctaatgccgtaataatggaaatcactttatatccttcattgatcagccgttttatggtgcccgctgctcccaatagttcatcatcgggatgagcgccgataaccataatgtattctgccattttttccacactccaccaaacaaatgttacaaatatcatatgacgaccctaaaaaaaggaaacttacatgtgcggattttcagaaacttacatgtgcggctgccattccaggtaacgtgacggatttaatttttttatagtattcaaaaactcatccgccaagccgtatttgtccagtccttttaatagttttacgggaaaccgggtaatagcggaaaaagctcttttatggtcgatgactttaagatttccgtgttcattgatcagaatgtgcctgatttcggcatcccatctggtaaaaccgattctttttaattcatccagcatatttaaaatatcagcagtcagtttgacggacagggatttttcttttctgatatggcgggcaagagaggtgccttggacgtattccatcacaatataacgatctccgtattcatacagtcttggaatcaccggggaaccttgtccggtctttaaagccgccaattccttcttgcatgtccctttttcaaagaagtattttatgcatttgttgtgtgttaagcggtagacttccccgtcttttccgtctccgatcagcggataatgctccagcgcctttttattctccggattattaaaatatgtttcagaaaaaaatcgtttcataccgacacatccttcgttatgatgtaatataatatgcaatctggtaacgatcggaaatgaaacaatctcatcattttcttgcgctgcgccgtctgctgcatgaaaaaaacccgccggatcggcgggtttttcattgtgtattacgcttcttcttttacgtgaaccttcagcacagcctgaacttcagggtgcagctttacaggaacgtttgtatatcccagtgtgcggataccgtcttggagctccagtttccgtttatccactttaatcttatgcgttttttgcagcgcttctgcaatctgcttgcttgtgacagacccgaacaggcggccgccttcaccggatttggcactcagctcaacagtcagctgttcaagcgtttctttcaaatctttcgctctttcaagctcggcaatcgcttcttttttctctttttctttctgtcctttcaatgcgctgatgtttgtcgcatttgcttcgacagcgaggccttttttaatgagaaagttatgtgcataaccgtctgctacgtttttcatttcgcctttttttcctttaccttttacatcttgtaagaaaataaccttcatctctgaacgcctccctcaaaatattcatcaatggcttccttcagccggacgagcgcttctgatacagaaatgcccgataactgggttgccgcattggttaaatgccctccgccatccagcgcctccataataatctgcacattgacctcgcccagcgatctcgcactgatgcacaccgtatgctcatcccgtctggctaccgcaaatgaagcttccacttcactcatcgataagagggaatcagccgcctgcgcaatcagcacctggtcaaagtactcctcttcgttctcaggaagagaagcaatcgcgatatgttctttataaagagctgtatgctggatcagtttcgcccgcttgatataagaaccgacggattctttgagaactttctgcaccagaaccgtatctgcgcctttcgctctcaaataagaagcggcgtcgaacgtccgcgagcccgtgcgaagggaaaaactcttcgtatccactattataccagctaacagggccgtcgcttcaatcatattgattttgagccgcttcggctggtattcaagcagctccgtcacgagttctgcggtggatgaagcgtatggctccatataaacgagcagcgggtctttaataaattcctcgcctctgcggtggtggtcaatcacaacgatgtgctcgattttgttcatgagacgctcttccatcacaagggacggtttatgtgtatcaacgacgacaagcagcgtgtcgtcatttgaaatctccatcgcctcttccggcgtgatgaaccgcgaccacagctcttcatattttttaatttcttcaatcaggcgctgaacgcttgatccgatctggttcggatcaatgacgatgtagccttctttgccgttggcctgcgccaccttcaatattccgattgcggctccgactgcgtccatatcaggaaatttgtgccccatgataatgacattgctgctttctgagacaatctccttgagcgcgtgagaaatcacccgggcgcgcacccttgtgcgtttctccatcggatttgttttgccgccgtaaaatttcaccttgccgttcggcattttgatcgccacttggtcgcctccgcggccgagagccaaatcgagactggactgcgccagatctccaagctccttcaaggaagaaaccgatgcgccgatcccgatgctgagagtcaaagatacagtgtgaacggatgttttttcacggatttcatccaaaatcgaaaatttcgcgttttcaagctccgttaaaatgtgttcatttaacaccgcgataaaccgctccgaggacgtccgtttcaggaaaatgccgtactcctgcgcccacgcatttaataatgaggtgacctggctgttcatcgtgcttctcgtttggtcatccagcccctgtgtgacgtcatcatagttatctaaaaagatatatgccagcacggttctctcattttcgtactgcttttcaatctgaatctgttctgtcacatcaaagaaatagagcagccgctcatctcttttaatcactactttaaacttccgctcattcaaggtgatcgtttccgaatcgacctcctgcttgatcagcggcacgacggcctcgcatgtgtcatacagcgagcgcccgacgagcgtactttcattaaaacaggaagacaaaaacggattcgcccactcaatgtaatattgatcattaaacagcataatcccgataggcatttccattaatgcctcttcgcctacttttttcaatctatacgataacgtggagatataatcgtcaatttcttttctgatcagagaatccgcacgcttaatgaaaaacaggatcacggcgagcagcacaacgccgatggctcctatcagccagttaaagtaaatgctgatgaggattatgatgattgacaatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaagatgagcggaaaaagcacacccagcacaattgctaaaacaggaacggctttcggcatctccatttcgcggcaatagaaaaaaataaacgctaacccttgaatacaaatcagcaagctgagaataaatcccccattcaatgaaaccgaatacagcatatgccctttttctaaaggcagaaaccctaatatcgtcacaataaaatacagaatgacaacgctttgcgggagtttgagctctctaaaaggcttcatcttcggaagatcaggggaaaatcgccgtaaaagcggccttgccatagcataactgaggaaagaaaaaacgatgccggtcaatacgagcactgtcggaaaaagatattgaaccgtgctcagctgactttccatcagcttgatctgcttcccgaactgatctccgtaaccgagctgctttgacatggtttctgctaaagacatcgactcccgaagctgggacatggtggtatcgatcacattcatattaagaaacacgatgctgaccacaaaaaaaacgacgccgcacagcacatacgccatagcgccggcagcaaccgcatagccgggctgtttctttttaaaataatatcccatggcgattcccgtacaggccgccgtaaaagcgcctgtaagcccggtaaacgaacctacaataaagctgacaggaaggctggcaagccccatccataccccgggcttcagaccgtgccgaatggtgtaaagaatgatcggcagcggcaaagcaaagagaagaattgcccccagtaaagggaggtacacgaccaaaagggaaatgattgcaaaaatactgatcaaaatggcgccttctattagagcccttgtatttttcacttactcacctcaaaccttgtatcattcgaacatacgaatagaaaagagcagcttagacgactgctcttttgacgccgcaatgtctctttcaagacctgaattttccataaactctccaaaatacacgtatatattttaacataagtcgaaatcgcaagtaaaatgagcgcggacagccgcaatgttccatgtgaaacatgaaaacagacaaacggacatccccgtgaaagaatgcccgttgtatcagtgatcctgatcatccatgaaaccagaagtatctctgtttttctttttggtttttcgtacatataacaagacgataacgataagtaagagagtggtcgcctgtaaaaccccgctgctgaaaaggaagaagttctttatcatgtcccacatatagtttcacctctatttcgtatttcctttacattgagtttccctttctggaaacttcaaaacatcaggaacaacatcgggaccggggcatatgctgaaagtgaaaatgaaggataaaggagattcttacactatgaccgagcggagaacattagcatggcatgaaacgttagaactgcatgagttagtggctttccaggcaaacggacttgtgaaattaaaaagaacagagcgggacgtaagcgatgccagattaaaacagctttaccgattttccatccattcgctggaacaaaatctgcgtgaactgcttcctttcttccctgaagctcccgcttttcgtgaggatgaaacagaagagcgcgctgattccgcgttttacagcggcggcctgctgagcatggccaaaacgtctgtgcgcaattacgccggagccattacagagacggccacaccccaattaagacacgttttcgtcaagcacttaaacgcggctatcaagtggcatcaaatgatctttgagtatatggaagaacgcggtcaatatcctgcttacaacctgagcgaattgctgaagaatgatgtgcgcaacgccagaaaagccatcgcgatgaaataaaaaaaagcagcaaggaatttaatcctttgctgcttcttatttttgagcggactgatcttgaggcgacgttttttcccggtatgtctcgagaaactcccggttggcatctccccatttcttcatttgcaaaacgatcggttccagcgacctgccgaattcggtaagagaatactccacctttggaggcacctgctgatatacctcgcgatgcacgatgccgtccgcctcaagctcgcgaagctgaagcgtcagcatacgctgcgtaatgctggggcaaatgcgccgaaactcattaaaccgcttttttccgccgatcatatgataaaacaaaatacccttccactttccgccgataacggaaagcgtcagttcaaccggacaaccttctttattcggatatatgttcatttttcatcctccatagtaccttttttgatactatatgctgattagcatctgacttacccagtattttactcgcaatcctcctcaccgctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctacgctgatctaaaaaataaactcggcttcaatgctgagcccgtccgccttggacaagtcaacggcgaaacacaatacgcgcttgattatttcaagcaggaaagcccgcgtttggtggaaacagccgcaaacgaagtaaacggcgtcatccttgttgaccacaatgaacgccagcaaagcatcaaagatatcgaagacgttcaggttcttgaagtgatcgaccaccaccgtatcgccaacttcgaaacagcggaacctctttactaccgtgctgagccggtcggctgtacggctacgatcttaaacaaaatgtacaaagaaaataacgtgaaaatcgagaaagaaattgcgggcctcatgctgtcagcaatcatttccgactctctgttatttaaatctccgacttgcacggagcaagatatcgcagcggcaaaagagcttgctgaaattgccggcgtagatgcggaagagtacggcttaaacatgctgaaagcgggcgccgacttaagcaaaaaaactgtggaagaactgatttctcttgatgcgaaagagttcacgctcggcagcaaaaaagtcgaaatcgcccaagtcaacacagttgatattgaagatgtcaaaaagcggcagccggaattagaagcggctctttcaaaagtaattgccgagaagaaccttgacctcttccttctcgtgattacggatattctggaaaacgattcccttgcgcttgccatcggtgatcaagcgtcaaaagtggaaaaagcattcaacgtgacgttagaaaacaacacggcccttttaaaaggcgtcgtatccagaaagaaacaagtcgttcctgttttaacagacgcgattgcagaataaccaaaacaccccggcaaccagccggggtgtttttttctgctctttcatcagacgtccgttttgtaagcgcttactctaaaattattttgacgcctattaatatacaatatataatatatcacatgtaaggcgttcttttttctaattattgtaagttgctatcacaacatcagaatcgggggtgtctatcctggaaaaacacgctgctctttcttattcacgaacaacaggcatttggcttgtgcttacaggagctatcttatggggggtttcgggaacggttgcccagtatctgttccagcaccgccattttaatacagaatggctgacttcggtgcgccttctggtgtcaggggcgcttctgctcggaatcgcgtaccgcaaagaaaaaggacggatatgggctgtttggaaagacagacaggacagaattccccttcttttattcgggattttcggaatgttaggtgttcaatacacctacttcgcggcaattgagcatggcaacgcggcaacagctaccgttcttcagtatttagggccggcgatcattacatgctttttagcgattcgcgcaaagagaattccttcaggaaaagagctgctcgccgtcttattggcggttgccggcacattcattttggtcacgcacgggaatgtcggaagcctgtccatatccggtctggccgtcttttggggaatcagttcggcgtttgcactggcgttttacacccttcagccgcatcgtctgctgaagaaatggggatccgctattgttgtaggatggggcatgctgatcggcggagccgccctcagcttgatccgcccgccctggacatttgaaggcgagtggtcctttcctgcatatgccgcgattgtgtttatcatcattttcggaacgctcatcgctttttattgctacttggaaagcctgaaatatctgagtgcctctgaaaccagcctgctcgcctgtgcagagccgctgtcggcagcttttttagctgttatctggctgcatgttcccttcggaatatcagaatggctgggtactttgctgattttagccactatcgctttattatctatcaagaaaaaataacctctcttttttagagaggttttttcctaggcccagagcaccccttagtctcaattacccatatattaaaaggccttttttcattttactatcatccaaaagaggaaaatagaccagttgtcaatagaatcagagtctaatagaatgatgtcgacaagtaaatcatgcaggattgttactgataaagcaggcaagacctaaaatgtgttaagggcaaagtgtattctttggcgtcaccccatacatattttaggtctttttttctgtaacaaacctgtcatccatgaatgcaggaggatcgaatcggcagatcgcaaaaaaaggtacatacaaaaggagacatgaacatgaacatcaaaaaatttgcaaaacgagccacagttctaacttttacgactgcacttctggcagggggagcgactcaagccttcgcgaaagaaaatacccaaaaaccttacaaagaaacgtacggcgtctctcatatcacacgccatgatatgctgcagatccctaaacagcagcaaagtgaaaaataccaagtgcctcaattcgacccatcaacaattaaaaatatcgagtccgcgaaaggactggatgtgtgggacagctggccgctccaaaacgctgacggaacagtagctgaatacaacggctatcacgtcgtgtttgctcttgccggaagcccgaaagacgctgatgacacatccatctacatgttttatcaaaaagtcggcgacaactcgatcgacagttggaaaaacgcgggccgtgtctttaaagacagcgataagttcgacgccaacgatgaaatcctgaaagaacagacacaagaatggtccggttctgcaacctttacatctgacggaaaaatccgtttattctacactgacttttccggtaaacattacggcaaacaaagcctgacaacggcgcaggtaaatgtgtcaaaatctgatgacacgctcaagatcaacggagtggaagatcataaaacgatttttgacggcgacggaaaaacatatcaaaacgttcagcagtttatcgatgaagggaactatacatccggcgacaaccatacgctgagagaccctcactacgttgaagacaaaggacataaataccttgtattcgaagccaacacgggaacagaaaacggataccaaggcgaagaatctttatttaacaaagcgtactacggcggcagcacaaacttcttccgtaaagaaagtcagaagcttcagcaaagcgctaaaaaacgcgatgctgaattagcgaacggcgccctcggtatggtagagttaaacgatgattacacattgaaaaaagtcatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggtccttacaagccgctgaacaaaactggtcttgtcctgcaaatgggtcttgatcctaacgatgtaacgttcacttactctcacttcgcagtgccgcaagccaaaggcaacaatgtcgtgatcacaagctacatgacaaacagaggcttctttgaggataaaaaggcgacatttgcgccaagcttcttaatgaacatcaaaggcaagaaaacatccgttgttaaaaacagcatccttgaacaaggacagcttacggttaacaactaataacaacaaaaagaaaatgccgatacttcattggcattttcttttatttctcaataagatggtgaattcaatcatggcacgaaaatggcccgttgtaatattgatctttttgggtgcgttcctgtttgtcggcttactgccgaacaaaaaccacaattcctctgacacaaacaacacggagcataagaaggattaccgggcggcgtatcattttacgactccggacaaatggaaaaacgaccctcaaaagcccatttttttcgaggggaaatatcattactactatctttataatcgggattacccgaacggcaacggcacagaatggcggcacgccgtatcagaggacttggtgcactggacggacgaaggcacggctattccgaaatacaccaacgaaaacggcgatatctggtccggttctgtcgtcattgataaacacaacaccgcgggcttcggcaaaaacgcgctggtcgccgtcacaacgcagccgacagccaaaacaaaagcccaggaacaatatttatggtacagcacggataaaggaaaaacgtttacttcctatagtgatcagcccgttatgaaaaacccgggaactaaggatttccgggacccgaaagtgatctgggatgaacaggatgacaaatgggtgatggccatggccgaaggagaaaaaatcggtttttatgaatcacccgatttaaaaaattggaaatacacgggcggttttatcactcagcagatcggcctcatcgaatgccccgacctttatatgatgcgtgcagatgacggcacagccaagtgggttctgggcgcaagcgcaaacggcaaacccgcaggcaaaccgaatacgtacgcgtattggaccggaaactttgacgggaaggaatttaccgccgatcaagaagaaccgcaatggcttgattacggctttgactggtacggcggcgtcacatttgaagacggtaatagcgaagatccgctgacaaaacgctatgcgctggcatggatgaacaattgggattatccgaatgaaacaccgacactaaaaaacagctttaacggcacggattctatcgtccgtgaaatccgtcttcagcagcaggacggcggcacatacagccttgtgtcagagccaattgaagcattgaaccaattaacttcttcaactgacagcatagaacacaaacaggtgaacggttcagagacactgccgatcaaaggtgatacatatcagcttgatatggatatcgcttggtcagatatcaaaaatgcaggcgtcagactcagagaatcagcagaccaaagccggcatattgatgtcggtatttcagcagaagacggctgtgcctatgtgaacagatcgtttacagaccagcctgataaaaccggtgcatacaccgaaagcaaagccccatttgacggaaacaaagggcgcgttcatctgaaaattctcgtggataaaacaagtattgaagtatttgcagacgatggaaaaaccgttctgacaaatgaagtgttcccaaaacacgaagatcagggaatcacgctcttttctgaaggcggctccgctgactttcagcatattgagatgaagcatctcggttcgattcattcttagacgtccctcttcatttctaacctgcgcccggactgtggtaaaatgcaaatatgtatactacgattcatgaggtgttccattggataatcaaaacaaagaacctgtgctgaaaagaaccatcatgcgggacgaagtgtatcgcacactcagaaactggatcataacgggcaagctcaaaccggaaacaaagttaaaggacaaggatttgtcggaaacattgggaatcagccgcaccccgatacgggaagccttattgcggctggaagatgacggcttggtgataacaaaagcgaacagatggacgcttgtcgctccgattgagttaaaagaagcggaaaacttgtattccatcgtctggacgcttgagaaactcgcattgcagcaagccctcccgcgtatggacgatgccgtgattcaagaattgaaacagctgaatgaaaatcttcttcaaacgatgaaagacggcgataaaatggccgttctggaagcggataatgcatttcaccatcgcatcattctgcttgcggacaacgctgaacttcacaaattgctagtaagcctgaaagtcaaaattcagagactggaaatccgctatttcagtgaaaatggcgctttaaacagatcatataatgaacactctgatatcattcacgcattagaacagcaagatgccgccgctgcttttacagcgcttgaagcgaattggaaaaacagtttagaacggctgcaaaacatggcatagcaaacgaaaaagccaaatcactcatatgatttggctcttttacggatatcacaagacagccgcgttggctgtcttgtttactttttgtttatatataaataaataccgtaatccgtcggcacagaagcataccccatctgtctgagcatggctgttatattcccgcggtgatacgttccgtggttcacaacatggaggatcatatcggccgctgcggttttcatgatgtcacctgacggatgctctatttcaagggggagactgatattttcctccttttgcaaaaatagtcgatatcggtctgataattccaaaaatagatcttccagctcttctatctctttagacaagatgtcctctttttgctgttcagctgatttcagcgtatcctccagacgctctccggagaacacatcaaaccaccccttatccgacagatacacatgagtcaatacaccggctatcgacggaaagacactttgaatctccttacggtacacatcctccggaagctctttaagccgggtgaatatttgctgatttgcccaaagatgataatcatacaattgcagtgccagatgtcccacattaccctctcctctctcgatatagaacgtacgttcctaattatactacactacatgccgctctgtaccattttcttcattcgcagctgagaaaatccgataaaagccgaaattaataagagaaggcctgcgccaatataaataaaccgcacgccgaatacatccgagataatccccgttccgataatggaaaacataaaaatgaactgaactaaagctgatctcgccgctaatatattgacccgtgtcttttcggtcgtgatattttgaagtaatgtttcctgcgtgagatctcgtaatacacaagccggccccatacacagcaccagaaaaagggccgtaacggcgcttgtgatcagcccgtaaataaacgtgaacattccatatgccaaggctcccgtcagcataagcggaatgagatgatgctgaagcttaccggataacttatagatgatcagtccgccgatcatcgtccctgcataatagactccgttgacatacccccaccaagcctctcctttatgaaggacgtcatgcacataagttaaggacacagacccgatccatatcatgcctgcccacgattcgatcacatccatcacaatgagaaccttgagctgtttttgctgaaataaatacacccagccgcttgccgcatctgcaaaaagggaacgttccctgactgctgccggcgcacacatgcgtacttgaagaaacagaatgatgcccaacaccgaagaaaccaataacatgacagtgacgatcattgtatcgctctctcccaggaacgctatgatgacgccgcccagagaccaccccgcaaactgaacggtctgatccgccgccgataataaactgttcgctttcgcccttcgatcaggaggaatgatttccccaatcagcgcgctttttatcggagcaaaccatccgttgcaaaaagaaatgcctccgatcagacaaaacagcagaaaaaagaatgcggatgaaccggtttggatgacaaaaaacaaacagactaacagtgtgatctgtatcaattgagaactgattaacaaagaacgaagcgtgaaccgaccggtgaccagcggcaaaacggcgctgcccaatacgcggcatacaatgctgacgagcgtcataagagaggccatcgccgtcgaaccggtttttgtaaacaaaaacaagatgacggccatcgtataaagtgaaaaccccaagttgatagcggtctggctgtataaaatagcgtaatacgctctcttcatattcatcctctgcaaccccactccctgattatgtaaatcataccatatttgccgatcagctttttttaaaaaaacagattgacatggaatccactccatctattaggctttattagcagaaagaagactttcagcaaataacaattaagaaggagtaacagctgatttgacgcttggttcaactgaaaattgacataaggatatatgtgttgaaacgagctgatcacatccggaaccatactcattccaagcgactgcaatccattgcttgcccccgctgatttgacattccccaatctatagtgatgtatataagaaatgattttcaaaacagaataaaaaaagagggcttcctttccggaagccctcactccgtctgctacgccaataaaagaaaaataagcgctagaacagccggaagtccttgttttacgataattgatttgtttgaagtaaagcctccgaaaatggccgcgatgaccacacaaataacgaaaaacatttgaatcatatggccaatcggatcagctccgaggatcagtccccaaatgaggccggcagccagaaatccattatacagaccctgatttgcaaacatgaccgctacattccggtcaccttctaaatgctttggcaatttgaaagaccgcttggcagccttcgaattgataaaaaacatttcaagtatcatgataaatatatgttctaaagctacaattccgacgaaaacagccgcaattatgtccactgtccctctcctctcagcttcacttcaaccttatttccattgtgcgattgtttcgataggaagacggtaggaagcatatccttcgtctgccgcttttccgattgataacagcatgaccggtacataacgctctttatccattccgaaaacctcggcaatcttttctttatcatagccgccgatcgggtttgtatcatagccgtgcgcacgtgctgtaagcatcagctgcatggaaacgagacctccgtcaatcagaatcgtttcacggttcacttgctccggcagtttttcaaaatgcgccgtcaaagcagcgatttgtctgtcttttacttcctgcggcatgtagcccagttcgactgctttagaataaatttcttctaaatagtcatcactgttcatatctgcgaaaaccgcgatcaccgcagatgatgtgctgacttgtgtttggttaaagctggcaagcggcgcgagtttttcttttccttcagggctgtcaatgacgaggaaacgccatggctgcgcgttaactgaagacggcgctgtcgttgcttcttccaatatttgagtcatttcttctttgctgatttttacagccggatcgtaattccgaatggaacggcggcctttcataatgtccataaaatcgtttgttttcagttctgttttcatgtgtaatacactcctatgctttcatattttctatattattctgcatctgcgacaatacgttttttaacatactgcgttcttcctcgctgacaccggcaagcatttcctttatgaaacgctctttctcctttttggaagcctcaattctctcccgcccctgatcagtaagccggacaagtataattcggttgtcctcgggcttccgccttcttgtgaccatttctttggcttcaagctgtttcaagtgtcttgtcacggctgcgccgtcaatattcacctttttctgaagatcgctttggctgatctcatcgacgtaaaaaagcacggcgagaagctcaaggcgggattggctgattccggtgcacgcttcaaacttcgtgccgatcactttgtgcagtgattggagctgatacaaaatctcgccttcctctgaacaacatgctgtcaaaacccatccctactttcttttgcgcaattaattgactagtcaatgtttgatatatcaataatatacatccgttattctttttttgcaagtgttttctccttttttaaaaaaagctgccggtgaacggcagctccttcttaatgattatggatttttctgaaattactgccttttacttcagcgacatcatataccgtcacaaaggcttgattatcaatgtcattaataatttccttcagtttggtttcttccaaacggttgatgacacatgtgatttctttgaatttttcatgagaaaaaccgccgtatgcttctttatacgtagcgctccggcccaattcttcacgaatggtctctaccattaatgcaggctcgttggtgataatctggaatgttttagaaccgcttaagccttcctcaaccacatggatcaccttggatgcgatgtagtaagcaatgacggaaagcaatgcgccttgcagcccgaatacaaaagaaacaaaaataaacacaaaaatgtttaaaaataaaatgagatcactcgtgccaaacggcagtttccgtgacagcagcacagccagcatatcaataccatctaaggcgccgccgttgcgcaatgccaatcccattcccaagccgagaataatcccgccgacaacggtgattaacagggtatctccctcaatgatagccggcgtgtggtggaaaaaactcgtgcccgcggcaagtgagacaataccgataattgatagaaacgcaaaacctttcccgatttgcttatatcctaaccagacaaacggtatattgatcaccgcaatcaagatcccaagaggcaaatgaaagagctgtgaaccgacaatgctgagcccggttacaccgccgtcagatacactattcggaatcagtacggtttccagtccatacgcggcaataattccgccgatgatgaccatgatggcccgtacgattgatttggctctgaatttcttacgtctttgtttttcgattgtactcatatcattccccgcttcaattattttgtcttatttaaatataccataattgatacttttcgttaaaaataagcctatcggctagttgaagcaggaaccgaggaaggagatttcacagataacgtatccatttatgactttaatcattcacaacgcaatcattcagtaaaaggaattatcatccattaatagtctcttttgtttcccttcttcacatattcccaatcatgctctatattttttctcacccgctgaagaaggctgaaaatggtttctttttcctcagacgtaaagccggacagggctacttccgcagagtgctctccttctctttgcaataacggataaacctttctccctttttcggtcgggaaaagtttttttatttttttattttgatcatcaggacgcttttcaacaaatccttgtatttccagttttttgatcgctctcgccgctgttgttcggtcaactttaatcatttccgccagtttttcctgtatcactcccgggttttcacatatacgcacaagatagagatactgcccttttgttaagtctaattctttaaattcaatattgctgatggaatccaatgcccgtgcgatcatgccgatttcccgcaaaatatcagtcatatcttttcaaacccttcatgtttttgttgcacttgcaatataaatgtttcgtcgttacttctataagaccacaagcaagccgtgcagtccagactaatatgtgaaaaggattgattgatcatgaggataaaaagaataacaacggaaattgatttgcaagcagcgcttgagattagaaaagcagtattcattgaggaacagcaagtacctgaatccgatgaatttgatcagttcgatacgcttggggaacagtgcgggcatgtcttggtttatcatgagaatcagcctgccggcacaggacggatccgcatcgtaaaccaaacaggcaagctcgaacgaatctgcatcctgaagccttaccgcaaatacgggttgggcaaagtaatcataagcgaatgagaaaacatggtaaaagaaaaaggcatcacccaatgtaaactgaatggacaaacacatgcggaaggcttttatcacatcttaaatagtccgattaaaatctattaataattaacagttgaagagatggtgaaaaaagctgattctctctattatggactcctgccgcgttacattttttctatcttcacatatctttactactaagtacgtttaaattgatttcaggaggagatatgaagtggaagaaacgagtatggagccatcacgactctgcaaagaatttgcaagaattctcaattcaacgcccagtgtcgtaaatggcgtatgtacggcgacaagatttcgaagcaacattcacccggtggtactcggaagaagagccgaggcatttccttttattcctcaggccttttcatttgagagcatggactcggaaggcagagccttatgtttaggtgagactgttttactgcaagaagaagtgaacccattaatgagtgaactgcgcaaattcggtatcatcgtaactgccgttcataaccattggctgtttgataaaccgcgtctgatgtttatgcattttgaatcaattgacaaacctctcaattttgcaagaaaagtgagagaggccctgagagttctgactactaaaactgtgcgtgcggtaccaaaaactgacggggaaatgattgaacggcatggtctttgtgacgaattcaacgatattctgggcggaaccatgcatacgtttgaaaatggaatttgtacagtaatgagatcacgaacgaatataaaaccggttgtactgggacggcccggaagatcatttttgctcattccgcaaatgttttcatttgaatcaatgacaaaagacggccgtgctctttgcagcggagaaactgtaattctgcaaaaagaaatcaatccatttatcagcgctcttcggaaacatgatctgattgtaacgtctctacacaatcactggctgtttgacaaaccgagactgatgtatattcatttcgaagcgattgataaacctgtcaacttcgccttaaaagtaagaaatgctttaaaagtgcttactgataaagaggtcgaaggttagcatgtttctaagtatcaaaaagcgattcatataatcgcttttacatatgatcagccgaaaacaaaaaagaggtcagacatttgtgttaaaaaacagccttataggctgtcgttttgtgtatattctattgatgagtttatactacttcatcccgcattccatacaagctctttatttctcaatggctttctacatgccgctgtgcaaacaccttcttagccactgaaagagcattaagtacacgcgggaagcctgtataaggaaccaattgggtgatactctctacaatctcagtcggtgttaatccggatgtaagccctgtattgatatgaagttcaagctgcggctcggttccttgcgttacaagggatgaaatggtaacaagcgcacgttgttgattggttaatcccggtcgtgaatatatatctccgtaagcaaattctataatgtacttacttacatctggagcgatatctttcaagtcttcagaaatctttaaatgcgtagaaattttatcatcgcttgttaaagtgtactccattaatttgtctaaaccttgctggtaacggctttgatccatttgaaattcctcctgaaaggtacttatttcctgacataagataatatatcgcagccctctctaaccgtaaaatacataaaaactataaaaaccattcatttttttcatgagtgatcttagtctacgtaattactcttacaaaaagatgaaatataccggataaattcgcgtactgcgtgtgaaacgtattttcctttttttaaaataatcgccactttccaaggaatggatggattgacaatggagattgccttaactaaactttgatcagtctttttcactatcgactgagggaaaatggaaatacctagttcttctccaatcatttcgctgataaaatcccattgagaactttcataaacaatatttggacgaaaaccggctctaatacactcctgaataatccgatcgtgaagagaaaagtcttcactaaacaggatgaaaggttcatttttcaagtcttgcatttccacaatctctttatgaacaagcgggtgagcggaatgaacgaagagcatcagttcttcattaagcaatggaatgatatcaaactgctctttgtccactggttcaataaccacgccaagatccagtactccatcttcaacctcctgtttcaccttgtttcctccatgttctatcagcttgatgttcacatcaggatacaattgtttaaaccctctaatgattttaggaaaaaacaagacaccgatcagcggcggtattccaattttcacttttcctttttttaaatgcaaaagatcgtataagttcgtcgacaagtcatctaatgacttcataatcatttggccttgctcaaatacaatttcgcccgcatctgtcaaagcgatttgtctagcggatcgatcaatgagctcaacctttaattcctcttccaaacttttaaccatcttacttaaggcaggctgtgacaaatgcagattttctgatgccttagtaaaactgttggatttagcaacttcaagaaagtatgtgatttgacgtatatccatcttatgatctccattccataattttaacgaatacattatattctttttattcattttactcatacaactgccgggtgtaaacttttaggagaccaaaatttttcctggaggggttactatgagtaaattattagaaagtaaagttgctcttgttacaggcgcggctagcggaattggtttagaaattgcacgtgaattcgctaaagaaggcgcaaaagtggtaatttccgatttgaacgaaaaagccgtgcatcatgcagctgaggaacttaagggacaaggatatgaagtccttcctgcggtttgtgatgtaacaaacgaagaacaagttgaaaaaagtttctctaagacacttgaaacctttgggcgaatggatattctggtaaacaatgcggggattcagcatgtgtctgatatagaaaacttcccgactgataaatttgaatttatgctgaaattaatgattactgctccttttagtgcgacaaaaagagcgttccctttgatgaaaaaacaaaaatttggccgcatcatcaatatggcttccataaatggtttaattggttttgcagggaaagcagcttattgcagcgctaaacacggtttgatcggtttaactaaagtatcagcattagaaggagcggaatacggaattactgtcaatgccttgtgtccgggatatatcgacactccattggtacaaaaccagttacaagatattgcagagactagaggcatttctatagaaaaggtgtttgaagaagtcatttaccccttggttcctcaaaaacgtttgttagccgtgcaagaaatcgctgattacgcagtattcctcgccagtgacaaagctaaaggagttacagggcaggccgtcgtaatggatggcggctatacagcccaataatctaaatttcatctgcaggagtaatagtgctttggattaaatgatttactcttcaagaaccaagccgatggttttttaggaaagacatagctatacagattgaagtttgatatatatttggtatattaacttaagaaaagccgccctgttggcggcttttttatcctgcatcctgtaatgtgaaaatgttaaaaagcaacggaatagttgttgtcttgcagaatgcgaagaagctgttggggctttcacaaagtatgtgggtgaagctgcagataagtgtgtaagattcccctctccccataatgcgcccgcacttttcatctcagcagcatgagcatccggcagagtagaattaatactattctgcttcaatttatcttcaattgttggtattctggcaacgaaatcttcataacgctgaaattggtcaaacggtatacttaattttccggatacatatataatcaacttgaaagaacattagaaatagtcgaagaaaaagctgcagctgtaaaaataccatctaaatggacattgatggagtatgcgtcaacaatataacaattaaattaaattaattcggttcctctttccctaaggagcctaaaaatcagtcacatcatccatcttcagccttcaaacattatcaagccttgatgaggcaagaaacacggggtatcatagacacacaaaaaagatctcattatccaaagtcagattgagtatttttagttatataagataaaggaggaaatagattgactttacatcattttattggggcggataaagaacttcctattggtgagtatggcagtaatcctacacttaagcccatttctgaactaaaaataaaaggagatgtcaacaaacgctctcaatttaaaaacaatcgaaagaacagtgaaaattcacttgtaaaggtttatgacacagaagaagatgcatacggaattgatattgttcatttagatcctggatatgaagcagtcagaaacaaattcacacatccttatatatatgaattacaagggtacttacatgccaacaatacacctggccaacgtaaatctattaaatcactttttcttttcattgaaaaacacttgtcaaaaggtgaatcaattgaaatatattcctgcttagatggatatgaagatgaagataaagatgaaagcatgggtgtagttatcaatttaaatactttacaatttggaaaacatataaagtttaaagatataaatcaccttagtcatatattctatttggaagataaacaatatgtattagtcaagaaataaacaagaaaaatcccaattgagtaatgttagtttaataagtaaggaaaccattctatacggtttccttacttatatatattattcactaaaatcattcaatttttttataaaaaattgaatgattttaatcccatctttcaaaatgcacttttaatcctggtatactcaatattctttgtatttctttatcatcttcagtatcgatataactttcttcttcatgagagcatgttaccaaccactcctttccatctttaaaaaaagacaagtcttctggtaaatgtggctgctcccaagaatataaagaatttgcggattctttcagaatgttttttgcgttttcatctgtataatagtaataaacttttgctttttgattgtctcctagaatggtactggcccattctgattgctctttcattacttttaacgaactttcaagtttttttaacagaggatcgaatgattttaaagatcccatatcttttcttaaaactaaatgaaattcgtcgcaaatctcgaaagccaaatcaattaactctgaatacagctgatcctttgggttgtggtcaataattaacatagttacctccttctcctattataatttcctatcttttaattactttaaagttaggtgtttataaattaatctaaattatcttgctgccccatagaaagcatgagctttcatacggacaccttttccatgtttatacctagagatcgagtgataatgataatgtttacctttaccctttttatctatctccggaccaacaatttttttaatcggacttgcggctttagcaatagatttggcattgttcttcgacgtagaccaagtgtcatcaccccttttaaggcgtgcaattgcagcaggtcttttcaaaccattaccgataaataatcctttagactttcttactgccatataatgagaataggttcttttacgcttcttaaactcagaataggcaacataagtcactcctgaaatagtcacagctaatccaattgaaattaaatgcgctaaaagtgcctctccaataactattcctataggtataaaccaaacaaaagaagctgttacctcatctgaattaatctcatactttttatttgtttccgtatcagtaaaagttgcttctatcttctcatttgtagcattttcaatatcaactttatattctttacctttttctccagtcttctgagaagtttcatcggttattaatgaaagtttcatattttctttatctaaagtcattaaacctttaactccgcctttttctgctgtgattactaatttctcttcatcatttgttacaatttggtaatccttattgtttatagcctcagcttttgattcattatgtaaaataaaagtaaaagttaatattagacttaaaaaaacagcaatactctttttaaaacatttcattgaaattagcccctttacttaaaagataaaaatccttttccataaatttcatctctccctttctttccaagatcgatggacaatttggacaatacacggttaacttgattataaatatcctcttttgaatcaattccgaatttatctctattttgtaaaattaatgatattactccggtaacatgtgcagctgctaaagatgtaccactttcagttttatatccattattgagggatagtatcggtatatctacaccaggtgcagaaaagtcaatctttcctttaggtgaaaagttagctagtttattatttctatctacagcattaatagagagaactttttcataagctgctggataatcaacatccccgccataattgttacctgcggctgcaacgattatgatcccactgtttactgctttatcaattgcacctcttaacaacggtttatcttcggttaatccaaaactcaaatttattacctgaatattattatcaatacaccactctatacctttaacaagggtatctagcgaaccttttccttctgaatttagtactttaactgaatatatctcagtgtctggagcaattccaactaatccaaagctattatctttagctgctataatgcctgcaatagcagttccatgccccacatcatcatctgaggttaaagtcatgtttattggattaaattcccctttaattttcccttttaaatctttatgctctttatcaataccactgtctaatatagcaactttcactttctgtttctctcttaaagtccatattgaagcagcattgatttttttcactccccatggtacttcttgtacacggttatgattaattttttctgtttcatttctctctatatgcttaaaaatgaataaaaagcacgcaaaaaaacctaatgtaaaaattaatataaataataaaatatgaggttttttaattgctaacaccactttttgaagatttgtaaatattctcatccttggccaagaataacaaacctattatatcaatctgcaattaaaaatcaaagtttttcaggaaatatttcattaataaattacggttataaagtagtgtaattcttagttcttagtcatcataaagaaaattgaccttcaaatccatatttaaaacaaatctcaataaagatcggcatattaacttaaataattttgaagacttctgctagtgatggttttaaagataatctctctcttacagctctttgaaaatcaagttctcctaagtattttttaaccagcaccccaaccgtagtcagcgaacaatccgcgtgtcattggtgtcatgtctctttctattaaagtaatcatgataaatttatctgcttgccaattccttaatcatcaaacccaattcataaattcccttttgaaggtcttcaagagatgcataagcatatgataagcgaatataattccctttttcttgagcatagatactgccgagattgagaagtatcccttttgataaggctttggtataaagtaatttcatggatatggaaggcaatgtttttacccagacaaagaatcctccctttgggatattccatgtcgccacatctttcaaatgagtttctaaaacactcaaggccaattctcttctcacctttaattgacttctcacctgttctagatgctgctggtattcaccggatataaaccactctgccgctactctctgggataacgaactggagccgtaatctgtttgcatttttatgtcggataaacgttcaatcactggttccggcccgacgatccagccaatcctcaagcccggacttaatgttttcgataaactgcctatgtaaagcacatgcccatttttatctattgttttaataggatccgggggaatctcatctatccataactcacgataaatgtcatcttcaataatgggaagctgtgtattctcacttgccgcaaggatttcttctcgtctcttttttgacattaaaatacctgtcgggttctgaaaacaaggatttgtatataatatagccctcccccgttccccccttgccatgcggatatgttccggcaaaattccatcatgatccataggaactccagtcagcttcataccggctgattgaaatacgtgtaatgaataaagataggaaggctgatcaagataaacggtcgatcccctttgtaaaagccccattgatataagctgtaaggcttgcagtgcgcccgaaacaataagaatggaagaaggagaagcttgaatgccgattgttcttaaatagccgcttaatgcctctctcaaaggcaaatatccttttggttcctcatatccgaatgcctctatgttttgggatacctttcccatgatctctttcataacagctaaaggaaaaatctcatgtgaaagttctcctttactgagctgtataagatcagaatttgattctgatttattgatctcttgaacgattttttggcttggctgctgaattccggaggttacatactgatcccaatcgggagaggaattcttagccaaaagtgtccatgtattgttcgtaacaactgtccctttgcccattctgccttcgattaatccatccgccgtcaattcctctaaagctgtaatgactgtgctcctgttcacctcaaagtgtttggcaagcgtgcgctggcttggaatcttacttccgatcggccattctccatttcctattttctcttttataaattgaatgatttgtatgtacttaggaagctttctcatctttttttcttctggagcgctcattaaaagggtcctccttaaaaactaaagtggttgggtcaaaatctatttaactggttgaagtcatctcatcaaatctttattaatatagaaaaacattaaataactggttggtttttgtaaagaggagtgagaaagatgagaaagaaaacagttcgaatcggcatagcttacagtctgatgattgggttgtgggcatcagctttcccgggaattcgcgcgggtttggagagttacacgccggaacacctcgctttgtttcgcttgttgattgggtcaatggcattggtggtttttgctgttttgactcatatgcgtttacctgacatgaaggatatccctgctattttatctttaggatttttaggttttgcactatatcacattttgctgaatatcggagaaaaaaccgtcagcgcaggggtagcaagcttactcgtgaccatgacacctattttttctgcaatgttatcccgtctgttttttggtgaacattttgggctttataaatggattggctctatcataagtttattgggtgtgtcgatcatttctttcggggcaggaaactatacaaattcagtgaacggcattttgttaatcctgctggcagctttttcggagagtatttattttgtctttcaaactcgctatataaaaaagtatggttttattccatttgtgacattcaccatttggggcgggacaatacctatgcttgtatttctgcctggcttaggggaagagtttttgaacgcttcaatgaactcaacattgtctatcgtttacttaggcttattaccaacggttgtgccttactttgcacttgcatacgtcacttcactcgtcggtgcttcagaagcagccatttcactttatttaacaccagccgtagccttggccatttcttgggtgtggttaggtgaagtacctgcgtttattgcactgacaggcgggttggttacagtcgccggggtgtgtttcacctatctaacagtaaataaaaagataaagattttaaatccttatttcttatctaaaaagcaataaagcagattacatttaaccctgaaagtagagtcataagcagttctcctttttaatacttgggtttcgaaggcttcttctccccaaggataccagtttacggggttgtgggcgttacctttgttcaagaaaacttgttgcaagcaaattcccccactcccgtaaagaattttgaaaacttacatggcagattgaacatttcttgacaaagttaaaatgtaaaaagatacaaagtgtctattgattaaattattcttttcgtttttattgcggttattgtatgtcttgtgtttcttgacaggtttttcattttcacaaataaaaaaacacgctggaaagatgctctaacgtgtcatgatttacttcaaatgagatattgttcaacccattttcttgcaatgttttaatgttgtttactaaatcgggtaattcagcaactgctgattctaatgatgccactccaattacatttattttccttggattcggtgcgtcgagatctaaagggacgtcttcattggcaggtattaatccgggttcataagcaaaagaaagactttgagcaattatcctcttcactccaatttcatgacacgcatcaacagtatttcgcgcacctataattctgattctcgctttttcttcaagattgtaacctgttaaagaggtaaactgatggacaacaacctcaggttaaattttcctaaaagcattaagaacagcatctcgatccattgcatctgcttttacaggagttacccctattcttttgaggaacgtgttcgaccggttaactcgggtcaatgcaaatactggatagccgttttgtattaatttaggaagaagggaccgaccaattactgcagtccccccagcaacaatgatcttcatgctataccttatttacctgccaatcttgaagcagcttcttcaacttctttatttgctttttgtaaaacatcctccggactcagtaaagctgttccttgcactcggataatttgataatcctcaataccgaggaaattgaacattgatttcagatatttatttgagtattcaacttcttcataccagtcatcatttgtataaattgatccgctagcttgtatgacaagcattcttcgtccatctttaagcagacctactgacccagtgtcagtatatctaaatgtttcacgtgcgatcataatattgtccatatagtcttttaattttgatggaatattgaaattatgcaaaggcaaaacaatgacatacgtttttgcacttttgaattgtttcaatacttctgtcatgcgtcctgttactttttgttcatcgcttgtcagttcttcgccttttcctgccttatcccatgcacttaaaactgttttatcaatcataggcacatcatcactatataagttaatttgctcaagctcttcactctctggaattaattctttgtaagcctctaaaaagtggttcattacccgtaaactgtatgatgacgtatcatctacttttggatgtgcgttaatgataagtgttttgctcatttgaaactctcctttcattttatattaaagactatattaatcgacgattaacttggtcactaatataaaccttgtattttattttgtcaaacggaacaaatagtatctgaagaagggttttaagattgactatcatcaaaaatactcctaagatacaatgtgataaaccttaaaatcaaaagcaggtgagtttatatgcagtacagtgttggggttgaatatgctttacattgtctggtttatttaatagatgttccctccaaggaaagtgtcgggattcgggaccttgcagagttccaaggactttcagaaacatttctttcaaaagttttcggtaaattatctaaagctggtattgtaaattctgtccctggtgtaaagggaggatataggttagcaaaatccccggaggatatttccttttgggatgtaatagaggctgttgaaggaccaaaacccatttttcaatgtaaaaatattgtaagcaatggtctactttatcgagacaaatgcaactcttgtgaatccagcaattcttcttgtacaattaacttggtaatgcttgaagcagaagaacagatgcgtaattatcttcgtaataaaacgctcgcatggttaaataaagaattggacgtagtattgcctaaaaaaacaaggacagatactcgggaatacttcataaaaaaaagctctgactaaattaattagtcagagcttttttgtgcttcaagatgccttcggagaatttttacgaaagtatggacgagacaacaaaatgaataaaactacagattaagtttaacactccgattcggagagtcaaaggttaatgttcgcctttttgttctactttatgaaagggtcagcaattgctgatattataataattaatcaactctttgtggaatggatgataacaaatgacattaggccaaagattaaaatgggctcgaaaaaaatccggttactctaatcaagacgtgacagcagagaaaattggattaacagggtagacattgtctaattacgaaagggattatagatcgtccgatccggagacattaaagaaactcgctgatttatatgatgtatccactgattttttggtcggtagagaagaaaaggacagacccaaatctaaattggatcaaacagtcaatgaagcaattgaacaacttaaaaacgaagagactttacttttcatgaaagatgatgacattgacgaggaaacagctaaattaattaaacaggctttaatcaatggaattaaatatgtagatgctatgaaaaagaaagagtgattcttatttatacttccaaaaacatcaaacacaaagctgaaaacgttattcatgagcatggcacaaataatgtttatcagatttgtgaggagctaagtattgttatactaaaggagaatttaggcagcatcagtggtttcctacaatattacaaagaaaaagacacatacctcatacatgtaaacaagaattctgtttatcctaaccttataatcgctcatgaattaggacattactatctccataagaacttaaactctttccaaatggaaaactgctccttagtgcttgggaacaagttggaaattcaagcaaacatctttgcaacagaactacttctacccaatcatgtccttactaatgaattacctaacctgcatagttggacactaaaacaaattgcctcgttctttcaactccctttatttgtggtagaggacaaaatggaacatataaacctcttatcacaacaccttttggagaacgaaggaagattggcaaaattcgcttggtaattctaactaagctttatttttcttaattgaaagaagatgatcctataacaaatattatatgactataaataaaaaagtgaggttttatagacctcactatcaaacagttcactactcaattattttttcattgtttgttgttgcgcttgcgttttcaacactatgtgcttcaccatgaccaggtccaaaaagatttaatattacaactcctacaagtatcaaaacaatcccagtaacactggcaatgttaattttttctttccaaatcaaaatcgaaattattgtagtagcaatagtccctacaccagaccaaactgcataggcggtattcaaaggtatggacttcattgcaagtgataagaagaaaaaggaacctataaaagcaataattgcaccaatagtagggtaaagtttcgtgaagccttctgcggccttgagcatagaggaaccaataagttcaccaaaaattgcgagcaataaatataaatatgccattgttaattctctcctcctgtataaataatcaacgtcttataaatttgtactaaacctctataggtttgtttcattatttctttattagttacaactttacaagaaacagcaaatgtttataagtctttattttgcaaaaaaattgtgcgcaaaatgactggtgttccttagacgagtagataaaatctaatctagttaatctaataaggtataaactaaactccattatggtaaagtaaaaaatagcaaccaatttaaaagtgaaagaaggtgagcccatgccaaacaataataaacccaacagtttaatcacggagaagtccccctatctgctccaacacgcccacaaccccgtaaactggtatccttggggagaagaagccttcgaaaaagcgaaacgcgaaaacaagccggttcttgtcagcatcggctattcgacttgtcattgacgccacgcagattaccatataatcctctccaattccctccattaaaatttttcgatccagaggggatgctttatctttaaattgctgaatattataatgttgataaaaccattttttacaggtttattaagacaaatgaaagcagaaggattatgatcatgaagaattttttctctattggagaggtatccaggttatttcacgtcaaaatatccactctcagatattatgatgagatcggtcttttgaaacctgcatacaaagacaagcaaaataactacagatactattccacagagcagtttgagagactggatacaatcaaatatttgcgggctttaggcttgccaataaacaaactcctagatttttataattcccacaatgcagataccttaattcaattactgaaaaaccaaaaaaccgaaatcgatcgtaaaaaaagggaattagagcttattgaaaaaaagatcacccgccgtttaaacaaaatagaagatgccgttaataaaccgttagacaaaattacaaaaatcaaacttccggagttgcgtgtcgcttatttacagcatgagtatattctaggtcatgatattgaacactctctaacagaattgagaaatgatcttactattaaagaagacatatttttaggaaagattggattatcgatttcagtgtcaaacctaaaagcgcataagtttgatcgttactccagtatttttatgatcttagaagacgagcataatttgcccccatcagtaatcaccttaccatcaaatgaatatttacaaatcaggtttaaggggtcgcataaagaggccaaacaatattataaaaagttactgacatatatgaaaaagcatcatctggagttagcggccgactccattgagataacgttaattgattatggtgttactaataatccggatcattatgtgaccgaaatcatgctgcccattaaataatcccttgactctctagttactggagagtttatttttttaaaagcacactttattgggggagaaagcacatgattggaacaatttttaacacatttatgatcttcgcaggatgtttactcggagggctattcaagaaaggaatgaaaggtgaatatcaagatattcttatgcaagcgatggggtttgttgcagttggattaggaataaacgccattacacagcatttatcggatagtaaataccctattctttttattgtaagtttagctgttggcggactacttggacagtttgtaaatttggaacttagattcaaccatctagtcagcaagttctctaaaaataacttagctgaaggcttatcaactgcaatcttattgttttgcatgggatcattgtcgatattagggcctattgaatccgcgatccatggtgattccacttatcttcttacaaacggtatgttggatggcatcacttctattgttctcgcatcagcgtttggctttggaatagccttatctgctgttgtgttatttgcctggcaaggctcactctatttatttgcaaaagtaatggagagtgcattaagtgcagacatgattaatgaaataacaattgtgggcggaatactgatactaagctcggggttaagcattttgggaattaaaaaatgtaaaaccttaaatcttctgccatcacttatcattccgcctgttgttatctttgttatgaaagcttttggattaggcgcatagctctatatcagttgtcaggcaccttgtccattctgtcaactacagactagttttctttagacagaaacaaataaagaatagactgcacatctttatggtacagtaaagatatatcaacggtaatacgaacgaaagaaggtgatcccatgccaaataaaaaagtacccaatagattaatcgacgagaagtcaccgtacttactccaacatgcttataatcccgtggattggtatccttggtgcgatgaagcatttgaaaaagcgaaacgagagaataaacctgttctcttatctattgggtacgggtagcttagcgaacttgccactggtgccatgtaatggctcacgagtcctttgaggacgaagagatcgccggtatgttaaacgataaattcatagccgtcaaggttgatcgtgaggagcggcctgatgtggattccgtgtatatgagaatctgccagctgatgacggggcagggcgggtggccgctgaacgtgttcgtcacaccagatcagaagccgttttatgcggggacgtattttccgaagacgagcaaatttaaccgtccgggctttattgatgtgcttgaacatctgtccgaaacgtttgcgaatgaccggcagcatgtcgaggatatcgccgaaaacgccgccgctcatcttgaagtcaaggttcacccggctgagggcatgcttggcgaacaggcggttcatgacacgtatcgccagctggccggcgggtttgacacggtgtacggcgggttcggccaggctccgaaatttccgatgccgcatatgctcatgtttctgcttcgctactacagctatacgggcaaggaacaggctttggccggcgtaaccaagacactcgacggcatggcgaacggcggaatttttgatcacatcgggttcggattcgcccgctactcgactgataatgaatggctcgtgccgcattttgagaaaatgctgtatgacaacgcccttctcctgactgcctatacggaagcctatcaagtcacgggtaatgagcgctacaaacagattgcgatgcagatcgtaacgtttattcagcgggaaatgatgcatgaagacggcagctttttctcagctttagatgctgataccgaaggccgtgaggggaaatattacatatggtccaaaaaagaaatcatgaatcttctcggtgatgaactcggcccgctttattgcaaggtgtataacatcacagatcaaggcaattttgaaggcgaaaacatcccgcacctcattttcacgcggcgtgaggccatcctcgaagagaccggcctcaccggacatgagctggccgaacgccttgaagaggcaagaacaaaattgctggaagcgcgtgaaaacagaagctatccgcatacagatgacaaagtgctgacctcatggaacgcgctcatgattgccgggctggcaaaagccgcaaaggtatttcacgagcctgactttctcagcatggcggaaacagcgatccgctttctcgaacgtcacctcatgccggacgggcgcgtcatggtccgataccgcgagggcgaagtgaaaaacaaagggtttatcgatgattacgcttttctcatctggggttaccttgaattgtatgaagcgggttttcatccgtcttatctgcagaaagcgaaaacgttatgtacaaacatgttggagctgttctgggatgaacggcacggaggttttttctttacggggaatgacgccgagactcttcttgtcagggaaaaagaagtttatgacggagccgtgccttccggaaacagcgcggctgccgtacagctgcttcgtctcggccgcctgacgggtgatgtatcactgattgaaaaagccgaagcgatgttttccgtgttcaaacgggaaatagaggcctatccgagcagcagcgctttcttcatgcaaagcgtactggcacacacaatgccccaaaaagaaatcgttgtgttcggaaggaaagatgacccggacagaaaacgtttcattgaggcgcttcaggagcatttcactcccgcctatacgattctcgccgcagaacatccggttgagcttgctggcatttctgactttgccgcgggttatcaaatgatcgatgggaagacaacggtctacatttgtgagaatttcgcctgccggaggccgacgacggatattgatgaagcgatgaacatcttacaaatcagcagcagagcctaggcggcctgctgcttttcttttttcacaaaacggaatgcgagccatgcgaagatgatgttgatcaccagagtcgatatgcaatcgtatatttcatagccgccggctgctgttgtaaatatcgacggaatgccgccgtataccgaatgatcctctgtgagaaagataaataaaaacatattattggcagcgtgaccgccaagggacatctccagactgcccgttttaaccgtgataaaggtccagatcatgccgatggtgacatatccgattcccgcccagagagctccattttccatctccggatttccgaaatgaagtgcgccgaataatccgccgataatgaccgtcagaaccaccgcgtttgccgtcaattttccggcaaactgaagcagaaaaccgcgaaagagaaattcctccgcagaggtttgaatcggcaccaacaagacggccgccgctaacagcagcagaaaacgtgaagcatggaattcctgaagcgtgaaacgatccggatgaattaaaaaatcaatcagccccgcgacaaacatcagcacaacatatgtgccgaatccaaagaaaattctcttccagttcagcgactgattcggtgtaatgatggataaaaaccgccgcttcataatgaaacgaaccgctatccaaatgcccggaatcgctatgaaatagacgatatgctgtaaataaatatccgccagcgggtcacttaatgccgcctcatcccaatttatcgtcagtgaaggattgaaagcggacgtgagaaacatataaaacacggtcagtatgcttccgaaaaagaacaaacccacaatgagcaacagagaaagaagatatctcgatacactatttcttccctctgcgggccgtacaaacgtattcatatttatgcatcaacttcctttccttcaacattttacaatataaacagaaacagatatagaaaatgttatatattttaagaagaaagcgctatgccgtttcctttggctctggttatttacactctgtttttgccaaaaaaagacctttataatgtattcgtcagataaatttacagtattttctgattacaattgctaagtcagggggttttttatgaaacatcagacattctcaaatgtagcgaaccgattagaccgtctccccatttcgcgtgtgcactatcaagtattaaccgctctcggaatcatctattttttcgatctcgctgatctgtttacgctcagcaacgtggctccggcgctgattgagcattggggcgtgaagctgtccgtcattgctgacatcacggcggcatccttcctgggcatgtttttaggcgcctccatcggcggaagactgtccgatcggatcggcaggaaaaaagcgctgaattgttttgtccttgtcttttcgatctcatcttttctgaatgcactggcatgggacattccgtccttaatgattttccgcttcttgaccgggctcggcgtcgcggccgccatgattgtgacgaacagctatttggcggaattttttccatcatccgtacggggaaaatacatctccttttgcgccatgatcggactgatcggcgttcccgtcacaaacgttgtttccgcttttgtcattcctttaggctcatgggggtggcggctcgtattcgtatggggggcggccggtctcatttatttcttttttatccgccggcttgaggaatcgccgcgctggcacgaaaatcggggcgcatatgatcaggcaaacgccattatgaaccgtcttgaagcacgtatagagaaagaaaaaggtccgcttcccgcgccaaaagaggcggcagaagtacatacagtgaagcacgcaggctacttagggctgtttcagggcaggaatttaaagatcaccatcatcctgtcagcggtatggattcttgaaacctttggcttttacggctttgcttcatgggtgcccagcctgctgaaaagcaacggtatcaccatggaaaaaacgctgtggtacaatgtgcttcactctgtcggcgcaccgcttggcgcattgctcggttccatgatatccgagacgttccaaagaaaatggattctggccgcaagcgcttttctgactgccattgccggactgttatacggcatgacgtttattcccgtcatgattattgtgtttggatttgtcgtcaacgtcacggaacgggttttcacctcaaacttatacgcatatacatcggagccgtatcctacggaatatcgctcggccgggagcgggctggcatacgggctcggccgtttttccaatatattcggctccctgctcgtcggatttattgccgttaagctcggctacatcagcgtctttttgttcatcggcggctgctggcttctatgttccgttttgttaattctcttcggtccgaaaactaatgctcagcaaatttaatcaataaaacagtgcgggttcccccgcactgttacactgtgatttctatcaaattgccttccccatcctctatcacgctctcataatatccgtcacccgtcacgcgcgggccgcttacaacctgaaatccgtcatttttaaacgtctccgtcaattcattcacccgctccttgctgcctgtagaaaatgcgagatgcgcccatccggtcatattctgtgacggagcttcatcaatgccgccttttttcataagttccagcctgcatccggagtcaaacgaaagaaaatacgatttgaaatcttttttctcattatgataaaggtcattggccttggcgccgaagtatttctcataaaattctttcatccgttctaaatctttcacccatatggccgcatgttcaattcgcatatgtccgcctccttttttttctcaatctagttataaagcatgaaacccatttcagctcaagactttttccgctgaaattgatgcataatttgttttttagccgtttctccgtgcaaaaacagcaaaaatgcttcccttccgacccgttccaaatgaagttccagagatgggatattcaatgcccggctgacgctcaggtttccctcgccgatgatctccgcgtcccatttctgttctttcgcaaactggtacaagccggcagccacgtcatcactgtgcgcatagatggccgtcggcgccttgtcgaaaccccagaagtgttcacctgcccgctttccgtcgtccatatcatggcatccgatcagaatgcgggtttcatcaagagagccgaaaaccgccttatatgcggttaccttgtcggccgtactcgggcttttttccgcttcccgcacacatgtaaaagcaacgtcttgatgtccgcggtttttcaaatacaaaaagctttctctgtaagctgcctgcctgtcattataagcgcagggaatctcttgatgctgcgtatattcacaagcgacaatgggaccgtactccagataagacacagcggtttcccattcattcgcgcgggacgtgacaatcagtccgtcaatctttttcattttcagcagttcgaaataggtcatctctatagcggggtcatagttggtggggagaagggttgtcacgtaatcatgggcaaacgcttccttcgtgataccgtttacaattttgtcaaagcagggatggtcgctgtacggcaaaatcacgccgattgtattggtctttcctcgaatcagatcaatggcggttcgattaggggtataatccagctccttcatcacttgattcacaagacgccttttctcctcagatacgtacgggtgtcggtttaatacgcgtgatacggtagccaccgacacattcgccagtttcgcaatctcttttatatttgccatgtgctcctccgtttttggtgataaaaaagcagcaagagtggatttctcttactgctatctcatcataaatccactgtcatttcaacagggcaatggtcagaacccatgatatcggcgcaaatggccgcttcgctgatccgcggcttcagtctgtctgaaacaatgacgtaatcaagccgccagccgatgtttttctcacgtgcgttcgtcctgtaagaccaccaggaataggcgccttcccgatcaggatataaatagcggaatgagtcggtaaatccggtgttcagcagggcgctgaacgcttcccgctcctgatccgagaaaccggcgttcttccggttggctttcggattttttaaatctatctccctgtgtgcgacattcagatcgccgcataatatcatgggcttcttccggtcaagcttctgcagatactccttaaaatcggcttcccattgaagacggtaatcaattcgctctaatccgcgtttggcattcggcgtataacagttgacgacgaacaggttctcaaattcaagtgtgatcacccgtccttcttgatcatgatcgtcaattcccaatccataaaacacgtgaagcggcttttctttcgaaaaaacagccgtgcctgagtagccttttttcaccgcatagttccaatagtcatgatacccttcaagctgtaatgatacttgtccgtcctgtactttcgtttcttgcagacataaaatatcggctttcgtttcctgaacgtaagtattgatatctatctttttcatcacggcacgtaagccgtttacattccaagaaatcagtttcatgtgttcccccctgtccggctcagccggcattccagtgtttcaatgtttccgccctctaatgccagcagctgctttttcatttctaaaccgcctctgaatccggtcagttttccgttttttccgatgacgcgatggcacggaactgtaatcaataccggatttttcccgattgcggcgcccacggctcttacggctgccggtttctgaatcatttttgctatatccgaataggagtatgtctcgccgtacggtatgtccataagcgctttccatacagcaagctgaaattctgtcccgtaaagatccaccggcactgaaaaagctgatctgccattttcgatgtactcggacagctctgccgtgtaagacgccagcttctcatcatcacgtgccaatcggtattgcggcagtgatttttttgcccactgctcaagctcttcaaagcttccatgatttgaacctataaagcaaagccctttagatgtggcggctgtatacaggctccaatcattccgtgtgaaaagtgtccaatagaccattgtctctttactcatattgaacctccctgtcccattccggcagtttttcggtattctgtgggcgaattcccggttctctttttaaaaagagtggcaaaatgcgctgtgtttggaattccgaccgtcagagcaatctccatgactgtcatatcagtatgctttaaaaggtgttccgccttcgccaatcttattttctgtatatactcaatcggggatattcccctgatttttttaaatgtccgctgtaaatgataagggctgccgtgacacatttcggccagtacactaagagtcagagattcgtgataatggcggtcaatgtactcaatgatttgagcaatccattcttcatcaggaagacgaagaccgttcggccggcaccttttacagggacgaaaatgtttatcaagcgctgcatcagccgtatcaaacaccagcacgttttctttattcggaactctcgatttacaagaaggccggcagaaaatccccgtcgtctttactgcataataaaatgccccgtcataagaagcatcattgcgtataattgcgctccacttttcatcagtcaggatatttctgtctgtctccatctcagccaccccctgttcttcagtataaacaaattcattgcataagtacgtgtatttgaatagaggagcaagataacaaaggtgtaagaagcacttccatgtttcatgtgaaacatttcggcagaatggaggggggctgatataaaaaaagagcaggagcccgcaggctcttgctcttttctttcggcttactcgccagttacgtatggaagtaaagccatttgacgtgcgcgtttgatcgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttctcgttatgaatatagcgataatctattagaacggaagatcatcatccgagatgtcaatcggcttgccgtcgttggcaaatggatcatcattaaagctgttcccttgatttcgtctctggttgttctgatttccgccgaacggattatcattttggcctccgccaaagtattggcctccgccgctgtttccttcgttgtatccgcctgatccagaaccgccgctgtttttaggctcaagaaattgaacactttcagcttggacttctgtcacgaagacacgctgtccctgctgattttcataatttcttgtctggagtcggccgtctacgccggcaaggcttccttttttaagaaagtttgcaacgttttcggcttgtcttctccaagtgacacaattaatgaaatcggcttcacgttctccggactggttcgtgaatgtacgattcacagcaagagtaaacgtggcgacagccgcaccgcttggcgtataacgaagctctgggtcttttgtcagtcttccgactaatacaactcggttaagcatatgaaagaccaccttttaacattatatatttcaaattgcttattcttcttctttaacaacgatgtggcgaatgatatcgtcactgatcttagctaaacggtcgaattcagcaaccgctgcagcttcagactgaacgtttaagatttggtagaaaccgtcacggaaatcgttgatttcgtaagcaagacgacgtttaccccaatcttttgttccagtgatctccgctccgttagaagtcaatacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtcagtgtggatgatacccgcacactcaggagctttcatgccttttctgaatgtccatgcgcgcacttcctgttcgcccgccgtaaagtatgtcgcaaggccgagaagagagtatgacgctttaatcagctgatcaagacctgattcttcgatgccgagctcctcaaggaacatttgcttttcttcgccttccaattcggcaatttcagactcaattttcgcacagacgacgataacttcggcattttcacccgcggcgtactcacggattttcgcaacgtattcattgtctgaaggatcagccacttcatcttcgcttacattcgccacataaagcacgggttttgacgtaagcaaatgaagctgcttcacaagcttttgctgttcttccgtaaattcaacggaacgggcaggcttttcttgttcgaaagcttcttttaatttagacagaatgtcaaattcaaaaaccgcttctttgtctttttgcttcgcaagcttgcttacacgcgtgatgcgtttttcgactgtctccatgtcggcaagaatcaattcaagattgatcgtttcaatatcgtcaatcggatcgactttccctgacacgtgcgtaatattgtcatcagcgaatgcacgtacaacgtggcagatcgcatcaacctgacggatatgagaaagaaacttatttccgagtccttcacctttagatgcgccttttacgatccccgcgatatcagtgaattcaaacgcagtcggcaccgtttttttcggattcaccaattcagtcagcttttgcagacgttcatccggcacttccacgattcccacgttcggatcaattgtacagaacgggtagttggctgattcggcaccagcctgggtaattgcattaaataacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgccctctctctccttagattatccttttttaaccgctaccagacagtcaaaaagcgtacttcccattccattatcggaatttgaatcctttgtgagcatgttgacggagcctccgaatgccgcccacatgccttcatctatattcaccgtcttcgggtgagccttcttcatgattttcaccctgccgcgcagacggccgcggtcattgtatacctctgccgtatctccgtcttgaagtgaaagctcctcggcgatatccggcgacaggtccacctgaatctgctggagcttttcaataaacggcacgtgctgtgaatgattggagcgctgcgggtgaatggacagcagcgtatacggatatttcccggccagtccggcgtcgtgataaacagactcctccggcacttccaattgagggaggccgctgtatcctttctcttctgccagtgacgagacgaattcaaattttccgctcggggttaaaaattgaaaatcactccacggaacctgttcgaccggaagcggcatatgtcctttttcctttaattgctcaagggcgattccgattccttctttctccaaagaagagagccccatttttaagaaatcttccgcactgtaatcaaacagctccccgaatccgagacgctttgcgagttccgtccagatccagcggtctgattttgcctctccctgcggttccgcaagcttcttaccatattgaacatagtgatgatacatgctggaataataaatatcttcctcttcgaaaacaacggccgtcggcagcacatagtcacagagcttcgccgtatcggtcatgaccgaatcaatggccactgtgaccggcgttttttcaaacgcttccttcactttttttgtattcggcacctgtgtcagcggattgccgcacgtcacgatgatcatctcaatcggcgggtcggctgcattcagcgcctcttcagcttgagtcatcatcgaaaacgttctcgaacttttcttcaaatcaggacgagtgagctcggcctttgcaaagctttcaccgacttgcacatttccgaagttggcgccgccgcctttgataccgacatttccgctcgccgcagctaaagcgtcaatccaccgtatcgtcccgcccccgtttttatatctctgcatcccaagacccataaaagtggaggcgggaccgtcagcatataaatcggcaagatattcaagcgcttctaaagacgtttctgttttctcaataatctcctcaaaagaaatcgtctgcagaagcttgtctatttcctcaaaaccgaccgaatgcttttgaataaaatcagaatcggttctgccggtttggcataatatttttaaaacacccgccgcaagccagccatccatgccgggtttgacggatatataccggtcggcaagctttgcagtcgggttaaaaatagggtcaatgaccgtcagtgtcgctccttttttcttcacctgctgcagatgatgatagaggtgcatattcgtccgggacacgtttctgccccatacgatcacatgcttgctgtgataaatatcaagcggtccatgcccgtaagaacgcccgaaatcccagcgctgggcttcaatgccggaaccccagcaaatgctgcccgcaatctcggttacaccgccgtatccattgaaaaaacgctggtcgagcgccttcaaaagaccgttattggcgtagtcatgactgtgcagcactgcggcagtgcccaacgtctccttaatcaccgccattttttcagcaatttcatctaacgcctgctcccaggaaatgcggacaaattcgccgtctttcttttttaaaggaaaacgaagccgttccggcgcattcgttttcgtctccagcattctgccccggccgcaaattttcccttccgtaatgggatgattcgggtctccgtctactttcgtcacctttccatcctcaactgtcaccaaaaagccgcagctgtcccagcaattcagcgggcacgctgactgatgcactttgctcatcgggcctcttcctctcctctatatgaaaaagcatgagcgccagcccttatgatgtaggctcctcatgcttgacgagtacttttttcagctttctctcaaaatctcttctcggaatcatgacactgtgggaacaacccgtgcatttgatccgaatatccattcccatccgaatgattttccacctgttttcaccgcaaggatgcggcttcttcatttcaacaatatcattcaggccaaagtctttatccgccaagacccttcacctctctccatagactgctttatttattgtacaaaaaaagacaggataagagcaacggccgcactcaaaatgagcattatacttttttccatctccctaaaatagggtaaagaagaagacataccagcaaataaagacttaaaagcccgtaaatgggatataaaatggcgatcaaatctgaaaaaccgattgtcgtaaaaggcaccatcacagctaaaagaagagatacgagcgtccatctcggcaatttcacaaatgcaagcatgcggctggacagcccgaaaagaccggtcaccgttgtcgtatagatggctaaaaaaagcacggcggccatacaaagaaataacggataaggagcgccttcaaggacggcgaaaagaggaatctcatattgtgtaagactgcctgaaagctgtacaagcgtttcattgtaaacaaatgaaatcataccgaaaatcagcccgcttgcaacgcttgcgattttggcttctcccagtcccttcatatctttcccgattgaagaaagaacagcaacaacagaaagaatgtttaaggacgtgaaggtaatgcttgccggccaattatactggcgggtcaagtctatcgtccacgtgtaatgatgcgttgtctgaaaaaagaccaatgcatataacagccccgctacaagaatcggtatcaaaatactattcagagataatatcccttttatatcccaaaagaataaacccacggtcacaatgcaaagaagaaaaataccgatccaaaacggcagcttgtacatttgcagcgtcacaccgccgccggcaatcataaccatcgtcattgaaaacaaataaaacataataagcacatcatagactttagcaagagccggccccatcagatgctcaagcacaggtaaaaagtgcgttgattgaacccgatagctgatcttcaacacaatataagccgaaatcgtaaacatgactgtaaacaatacaatagccagtccgctttcgacaccgaaaaactgccatatttcctgcccgcttgcatacccggccccaatctggctgcttaatatgagcagcatccacttcatcccggctctccacaccctcatcacctcataaaatttctgatcatctccgcatattgctactatattgagtgacagcagcaaacattcatacaattgggacaaatatggtatgataacgacgattgactattcagaaaattcatttatgttaggcgctcaaatcatggacatcaggcgtttaatcgcaagtgatacccagccttactccgattcaggctcaaagctttaaaagatcacccggacgcaatcgccgtcagctatgaggccgtctgaaaaattcaaagccaggcttgaagccggcaatgccatcgtgcttggcgcctttgaacaagacagactgataggaatcctcaagatctccaagcattcgctgtttaaactaagacacattgcggttattggttctatgtatatttcccccaaaaaccgagggtcaggcgcgggaaaagctttaatgacggaagccatcagccaagcaaaaaagatgaaagacacagaacagctccatctctctgttacttcaacaaatgaacccgcaaaaaaactctgcgctcagttaggatttatcctcttctctgcagaaaaaagagcgctgaaattagatcatcagcaatatgttgatgtagatcaaatggtcttatttctttcatgaacttagagaataactgctctgggttcttttttctatcccgctcttttcaaacaaccggcatgctcatcaacataagcataaaaaaaggcagcgctggatatactgtaaacaaccatacatcaccaaaaacaacaatgtaatactcgtatgacatgacaaggaagtgaaccttatgaatcgaaaaggcgggcttttttctcaagaacgggcaaaacaatatgtttctcatacggattcttctgctgcgaatcaaatacaagcaatccttacttcatctttacgtaaagcagccggcagaccgttagtcaccgtgtgtatcggtacagatcggtcgaccggagattcattaggtccgctcgtaggaacaaagttagaaaaaatgaatttaggcagattgcacgtttacggcacgctgtcagatcctgttcacgccgtcaatatgaaagacaagctgaaagatattcaacatctacataaaaatccgtttattatagcggttgatgcttgtttaggccgcgtcaaaagcgtaggctcatttcaaatcggcgatgggccgctgaagcccggagcaggtgttcaaaaagaccttcctgaaatcggtgacgtccatatcaatggaatcgtcaatgtcagcgggtttatggagtattttgtcctgcagaatacgaggcttcatcttgttatgagcatggcaaatgttttagcagaggggttacagctgacagataaatcagaaggccggcaggaacggctcagtccgtttcataagctgacaagacgtatataaaaaaccatcttttttaaaaaagatggtttttacgcttctctttcggacaatagttccaggatacgttcaagatcttcatttgagaaaaactcaatctcaatcttcccttttttcttttgtctcttaatattgactgttgttccgaagtaattttgcaaatacgattcccgctcttttaacacaacatcttgaacaggttcttttttctttgtttcacgtggaacattgttgtttaactgctgaatcagctgctcaagctggcggacgttcagctgttcttcaaccactttcttcacaagcggttcaagcttgtttttatttttcaagccaagcaaggttctgccgtgtcccatggataacgtaccttctgcaatgaggttctggatgctttccggcagcgtcagcagtcttaaatggttggcaatatgaggcctgcttttcccgagccgtttagcgagctgttcctgggttaaatccaaatgcttcagcagtgagtcatatgccagagcttcttcaagcggtgataagtcttcacgctgaaggttttccaaaagagcgatttcccgcatcagcgattcagataaatcccgcacgatagccggcactgtctctttaccggcaagttttgcggcgcggtaacggcgttcgccggctacaatatcatagcccttcaatgattttctcacgataatgggctgaagaatgccatgctgaatgatggattccttcagttcagctaatgactcatcatcaaattgttttcttggctgataaggattggggcgtaaatcactgattttaatttcttccactgtctcttcagacaaatcaacctgattaaacaacgcgttaatcccttttccgagcccgcctttagccattcgctgccacttcctttgctaaatctaaatatacttccgcacctctcgaacgcggatcgtataatatgatcggcttgccgtgactcggcgcctcacttaaacggacattgcgaggaataatggtttgatacactttatctctaaagtatttctttacctcttctatcacttgaatgccgagattcgttctggcatcaagcatcgtcagaagcactccttctatcattaagtcggtatttaaatgtttctgcacaagccgaactgtatttaataattgactcaatccttcaagagcgtagtattcgcactgaaccgggataacgactgaatctgaagcggtaagcgcattaatcgttaataacccgagagacggaggacaatcaataatcatgtaatcgtaattttgtttcacagattctaatgctcttttcagcctgacctcccgtgagatcgtcggaaccaattcgatttccgctcccgcaagctggatcgtggccggaatgacatctaagttctctactgaagtcggtttaataatttctgtaacatctgcatcatctactaaaatgtcgtacacacaatgatccacatcggctttttcaatccctaatccgctcgttgcattgccctgcggatcaatatcaacaagaagaacccttttacctatgtaagccaagcaagcccccagattaacagaagtcgtcgtcttcccgactccgcctttttggttcgtaattgctatgatttttcccacgatgtcacctaccttcatatgaacatgtactgtcttgtttctatcttatcaaaaaaagagtaaagcgttttatttttttcataatttgtttatcagcaagtgaaaaaaatgtaaacgaaaaagacactttctaatataagttctccgataaagtgacttttttgactgtaaaaagacaattcacgacacaaaaagataaaattttacatatataatgtatagtgcacaataaatctatcattatctcaaaatagttttttgattaaaataaaaactcccctgctgatcaggagagtttttatttaggtatccgaatggtaagctggatgtactcttcgaattcttcttcttcagtgttcagcctgacgccgctgtcttccaccatggacagtgactgacgaatcgtattcatcgcaattcttgtatccctgctgaacgctttgcgtctcggctttggtttctgcttattctgttcaagcattttcaccactctgtcttctgtctgcttgacgtttaagcttttctcaatgatttccgcaagcaatgtgacctgaaactccggctgtttgagcggaatcagtgctcttgcatgacgttccgtaatttttttctccataatcgcatcctggacgggttccgggagctttaacaatcggagcttgttcgcaatcgttgactggccttttcctaagcgctgcgccaaggcttcctgtgttaaatcatgaagttctaacagccttgcgtacgcatgagcttcctcaatggaggacaattcttccctttgcaggttttcaatcaaagcgacagatgctgtttccgtatcagaaaaatctttaataattgcgggaatcttctcccattcaagcgtctgtaccgctctccagcgcctttcacccgcaatgagctcatattgtccttcatcttctgtatgtctgacaacaatcggctgaatgatgccgtgtgtatggatagtcattgctaactctttgattttttcatctgagaaaatggtgcgtggctgaaaacggttgggaacgatagcatgtaccggtatttcgagtatctcttctttgtttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcgtcttgcgaatgatcataatgttccgttcactttcttcaacgggaagtataaaggaatgaacttgttcaagctctcctcccaatactttaatcgccttttgccccgctttcagctcttcatcagcggctgcagcttttaatgccgcaaaaataccgtttttcttggccagcggcagacaaagctcactcaggaccgacagacgcgccaccgcacgggccgtcacgagatcgaagctttcccggacgtctttccgctgtccgaatgtctccgctctgtcatggacaaatgtcgtatgctctaattgtaaagcatcagagagagtttccaaaaacgtaatccgcttattcagtgaatcgacgatggtgacatgcagatgcgggaagcagattttgacgggcaggcttggaaaaccggcgccggcgccgacgtcacaaagagtggtgaccttttcaaaatcaatataaaatgccgccgttatcgaatcataaaaatgcttgagataaacttcctttttctcagtgatggatgtcagattcattttttcgttccattccacgagcatccggtaatacaactcgaattgctccagctggcggtcagaaagggaaatccctttctccgctaaactggatgtaaattcctctatattcatgccgtcatcctttctattcagctaccttggcaatacggccctgctccaggtataccagcaggattgaaatgtctgccggattgacgccggaaatacgggacgcttgagcaactgataaaggacgcacttctttcagcttttgacgggcttcagtagcaattcctttaatggcgtcataatcaatccgatcagggatttttttgttttccattttcttcagcttttccacttgctgcaaggatttttcgatatatccttcatatttcacctgaatttccacttgttccgccacatcttgcggaaccggagaatctgcaggcgcaagttttgtcactgtttcatagttcatttccggacgtttcattaaatctgtgccgcgcactccgtctttcagctcgcttccgccgagtgaacggatatattcctgattctcaggagacggcttgataataacagaccatagacgttttttctctgcctcgatcgccgcttttttcttctcaaacgcttcatagcgctcatcagaaattaagccgatctcatggccgatttccgtcaggcgaagatccgcgttgtcatgacggagcagcagtctgtattccgcccgtgaagtcagcagacgatacggttcattggttcctttcgttaccaaatcatcaatcaatacaccgatataagcatcggaacggctgaggatcacttcttcttttccaagcgctttgcggcctgcgttgatccctgccataattccttgcccggctgcttcctcataacctgatgtaccgttaatttgaccggctgtgtacaggttagggatttttttcgtctccagtgtaggccagagctgcgtcggtacaatcgcgtcatactcaatcgcgtatccggctctcatcatctgcaccttttccagtcccggaatggtcgccagcatccgctgctgcacgtcctcaggaagactcgtggatagaccctgaacgtatacttcctgcgtatttctgccttccggctcaaggaaaatctgatggcgcggtttatcattaaaccgaacgactttatcttcaatcgaagggcagtatctcggtcccgttcctttaatcataccggaatacatcggcgaacgatgcaggttgctgtcgatgatctcatgagtctcaggactcgtgtaagtcagccagcaaggcagctgatcggtaatgtattcaaccgtttcatatgagaaagcgcgcggaaccggatcccccggctggatttctgttttgctgtaatcaatggaatcgcttgagacacgaggaggcgtgcccgttttaaaacggacgagatcaaaaccgagctcctctaagtgctcagaaagtttaatagacggctgctggttattcggaccgcttgagtaagacagatccccgagaatgatccgccctcttaaatacgttccggttgtcagcacgaccgtttttgccttgtattcagcaccggtttgcgtaatgacaccgcggcactctccgtcttcaatgattaaacgctcggcaatcccttgaagaagtgtcaaattcggtgttttttccagcgtatgcttcatttcgtgctgatattggaatttatccgcctgcgcacgcagcgcccgtacggccggaccttttcctgtattcagcattctcatttgaatatgagttttatctatatttctagccatttctccgccgagcgcgtcaatttcgcggacgacaatccctttcgcggggccgccgacagacggattacatggcataaacgcaaccatatcaagattaatcgtcaaaacaagcgttttggctccctggcgcgcggatgcgagggcagcctcaacaccggcatgcccggcgccgatgacaatcacgtcgtattggcctgcttcataccccatggttttttcctcccttttatttacctaaacaaaattgtgaaaagagctgatcaattaagctttcgtggacggcatcaccgatgatttcgcccagcagttcccagcaccttgtcaaatcaatttgcaccatatcaatcggaacatcctgttcaatcccgttcagcgcatcatcaatcgcttgctttgcctgatgcagaatcgaaatatgacgggtgttgctgacataggtgagatctccgctttcgatcgctcctgtataaaatagcgactgaatcgcttcctctaaatcttgaatgccttcttctttcagcaatgaggtcgtgacgacaggccggcctttcgccagttccttgacgcgctcagcgtcaatcttagcctcaaggtccgtcttattcataatgacaatgacgtccattccctcaaccgcttcaaacaatttcacatcttcttcagaaagcgcttcgctgtggttaagcacaagcaaaatgagatccgcttccttcagaacctgccgtgaccgttccacaccgattctttcgacgatgtcttctgtctcacggattccggcggtatcgacaagccgaagcggcacgcctcgcacgttgacatattcctcaatcacatcacgcgtcgttcccggaatatcggttacgatcgccttcgtttcatggacaaggctgttaagcagagaggatttcccgacgttcggacggccgatgatcacggtagacagtccctcacgcaaaattttcccctgctcagacgtacggagcagcgcctcgatttctttcttcacgccgcttgccttctccactaaaagctgatgcgtcatttcttcgacgtcatcatattccggataatctatattcacctcaacatgggcaagtgtttctaacaactcatcacgcagacggcggacaagcgcggaaagccgtccttccatctggttcatggcgacattcatggcacggtccgttttggccctgatcagatccatcaccgcttccgcctgtgaaaggtcaatccgtccgtttaaaaatgcgcgcttcgtaaactcaccgggttctgccagtctcgcaccttctcttaaagcaagctggagcacctgattaaccgtcacaatacccccgtgacagttgatttcaatgacatcttcccttgtgaatgttctgggcgctcttaaaacagacaccatgacttcctcaataatccgtcccgtcgtactgtccgcgatatgcccgtaatgaatggtatgcgattctgccgaactgagcgttttgcctttcggacccttgtacattttgtcggcgatctttacggcttccgggccgctcagccgaacgatcgcaatcgcgccttcacccatcggagttgaaatcgctgcaattgtatccatgctgttcacctctctttatctctgtttccatctatataaaaaatttatttatgccaaaattaaaagataacatagtttggtttgaagtggaagatatgttatccacaaaagcagaaattcatcccttattactttaacttatccacatgtgaataacaattaattttatttcctaaaaccttttttatcaacagcatagaccgaaaaagaaaaaacttaaacgcaaaaaatgcgattctgctcaggaatagagccatttttaccaataaaaaaaccgaagttccgattttacccggacttcggttttctgctatctttatgggaaataacgagatggcggtaccggccttcaccggtagaaaacgttttgatatttggatgctttgacagcgcgtcatggatgatttttctttcacctgacggcatcggttctaaatgcacctcttttttcgttttcgacacttgcttggccagcctgtttgccagctgatccagaatttctcttcttttccgccgataattctcagcgtcgacaacggcttggcgatactggccggagccgcggttcaaaacaagctgcgtcaatgtttccaaggcattgagtgtttgtcctcttttgccaataagcagcgccgctttttcacctttaatgtgaaaacagactgttttcttgttttcttccgtaacaatctcagaaggcccggcaatggaatggatgatttcttctaaatacgctttcgcttcctgaacaggatttcttttctcttccagttctacgatcgcattcttttttccgaaaatacccaaaaaccctttatattcttcttgcaccaccgttatttctacttgatctttcgtcagttgaagttcctgaaggcctgattgaactgcttcttcgacattccgtcccgcagcagtcaccttcttcactttttctttcctccggctttctgcgtttccggatcgtgtttaatgtcaggtcctttaataaggaatgtctgagcaatcataaacaggtttccgactacccaatacagagaaagcgcgctcgggaagttgatcgcaaatacgatgatcatgatcggcataatccataccatcattgccatttgaggattctgagtcggatttcccgccatcatcagcttctgctggacaaaagtggccacaccggcaacgataggaagaatatagtaaggatccttctctcctaaatcaaaccataaaaagctgtgctgtgaaatggcttgcgtacgcataatggcgtggtagaatccgatcaaaatcggcatttgaatcaggatcgggaaacatcccgccagcgggtttaccccgtgctttgaaaacagggccattgtttcctgctgaagcttctgctgcgttttttgatctttagagctgtatttttctctgagcttctgcatttcaggctgcagcgcctgcatcgcttttgagcttcgaagctgcttgatcatcagcggcagaatcagcagacgaattaaaatcgtaacgatgatgatcgacaaaccatagttatcgcccgtcagtttcgctacgtacgtaatgacttctgacaatggatacacaacatatttgtcccagaaatgcggactattcgccgtaatcggctctttcacactcgagcacccggccagcagcacgagcataccgaccatactcagtagtaaccatattctccttttcaagaacgtttcctcctataccaatctttataaaccttgtatgtattttagcatctttcagtttcaaatggcgttcatttttcgccaaataaaaggaagcgcttttaaaaacgtgaagaaaacaaaatatgagctattttgacgaagatttcttatataatgaggtttttctgaataagtgctgcagactctttttcgtttcttcaaaactgaggtcgccggcgggttttcttgcgataataataaaatctttcggcttgagcagctctttttcctcctgaaccgcctgcctgattaaccgcttcacccgattgcgcacgacggcattgccgatttttttactgacagaaagccctacccggagctcttcctgtttcggctgatcaagcgtatacagcacgaactggcggtttgccatagacgttccgcgtttaaacactttttgaaaatcttcatttttctttaaccgatttcgcttcttcactttaattcactccgatattcactcgcagaaacttttatttctatttaaaaaaaacgggccgccggaatactgaagaaatttctccagtaccgggcgacgcatgacatctcttttctcttaatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagattagaaaccttatttttcatattcctttttttaacgcacaaaaaaagccgcgctcccccgaaaaaacgacatgtggataatttttcggtctttttttaatatccacaatcgttatcgacaacattttcacattgctaacccctgtggacaaagatttttcaacaagttgtcaggtttgtggataagattacgagaaccattgcaagtcctcgcttaatttgatattatatttgtgttttaactcttaattacttatccagtccattctctttatccacaaattgtggataagttgtggattgttttcacacagcttgtgtagattgttgtccacaacttgtggaatttgtcgaaaagctatttttctactatactatatgttttcaacatttcgtgtgtacgaatggtcagagccatatgctctttttttgtgttctataacaggggaagggcgctgatttttaaagaaaaggagggctgtgccggataatggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgcttaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacgcttcatgaagaaagcaaacaaatcgtgatttccagtgacagaccgcctaaagagatcccgacccttgaagaccgcctgcgttcgcggttcgaatggggattgattacagatatcacaccgccggatctggaaacgcggattgccattctgagaaagaaagcgaaggcggagggccttgatattccgaacgaggtcatgctttacatcgccaatcagattgacagcaacatccgcgaactggaaggggcattaatccgggttgtcgcctattcatccttaatcaataaagacattaacgcagacctggctgcagaagcattgaaagatattattccgtcttctaagccgaaggttattacgataaaagagattcagcggattgtcggacagcagttcaacattaagcttgaagatttcaaagcgaaaaagcgtacgaaatctgtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataatagtgccctcggatgaatcggggaaagtgtgaataactttttcatagccatgcacagtctgtccacatgtggataggctgtgtttcctgtctttttcacaacttatccacaaatccacaggccctactattactactgctatttttaaaatatattaattatattatccgttaggaggataaacatgaaatttacgattcaaaaagatcggttagtcgaaagtgtacaagacgttctaaaagccgtttcatccagaaccacaattcccattctcaccggtattaagatcgtcgcctcagatgaaggagtatctttcacaggaagtgactctgatatttcaattgagtcattcattccgaaagaagatgatgataaagaaatcgtgacgatcgatcagccgggaagtatcgtgctgcaagcgcgtttcttcagcgaaatcgttaaaaaactgccgatggcgactgttgaaatcgaagttcaaaatcaatatttaacgattatccgttccggaaaagccgaatttaatttaaacggccttgatgcagatgaatatccgcatctaccgcaaatcgaagagcatcacgccattcagattccgacggatcttttgaaaaacctgatccgccaaaccgtgttcgctgtgtccgcctcagaaacacgccccatcttgacaggtgtaaactggaaagttgaaaacggtgaattattatgcactgccacggatagccaccgactcgctttaagaaaggcgaagcttgatattccggaagacagtacttataacgtggtcattcccgggaaaagcttaaccgagctgagcaaaattcttgatgacagccaagagctggtggatatcgtcattacagaaacccaagttctgttcaaagcgaaaaacgtattgttcttctcaagattgcttgacggaaactatccggacacgaccagcttaattccgcaggaaagcaaaacggaaatcgtcgtgaacacgaaggaatttttacaggcgatagaccgtgcttctttattggcgagagaaggccgcaacaacgttgtaaaactttctgccaaaccggcggattcgcttgagatttcatcaaattctccggaaatcgggaaagtggtcgaagctgtgctgtcagacaagattgacggcgaggaattaaatatttcattcagtccaaaatatatgatggacgcactgaaagtacttgaaggagcggacatccgtatcagctttacgggagcgatgagaccgtttcttatccgtacgccgaatgatgagaccatcgttcagctcatccttccggtcagaacgtattaatcaaacagaatgtgctgccggcttagttcggcagcttttctattcatcagccgctccctcaagttttccctttccttatttcaggattttttagtacaattagatattagtgatatttgaaagaggtcgatattatggcaaatccgatttcgattgatacagaaatgattacgcttggccagtttttaaaattagccgatgtgattcagtccggcggcatggcgaagtggtttctgagcgagcatgaggtgactgtcaacaatgaacctgacaatcgccgcggcagaaagctttacgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccagggcaaaaccaatctgatggaagccatctatgtcctttcgatggcaaaatcacaccgcacctcaaatgacaaagaacttatacggtgggacgaagactatgctaaaatagaaggaagagtgatgaagcgcaacggggacatcccgatgcagcttgtcatctccaaaaaaggtaaaaagggcaaggtcaatcatatagagcagcaaaaactcagtcagtatgtcggagcgctgaacaccattatgtttgcccctgaggatttaaatctcgtcaaaggaagccctcaggtgaggagaagatttctcgatatggagatcgggcaggtttctgccgtttatctgtatgatttatctctttatcaaaaaatcctttcacagcggaatcattttctgaaacagctgcaaagccggaaacagactgaccggaccatgcttgacgttctcactgatcagctgattgaagcagccgcaaaagttgtcgccagacgtctgcagtttacggcgcagcttgaaaaatgggcgcagccgatccattccggcatttcccggggaattgaagaactgacgcttaagtatcacacggcgcttgatgtatcagatcccaaagatttgtcgaaaataggtaacagctaccaggagtctttttcgaaattaaaagaaaaagaaatagaacgaggcgtcacattattcggaccgcatcgggatgatgtccttttttatgtgaacggacgcgatgtgcagacttacggttcgcagggacagcagcgtacgacggctttgtctctgaagctggctgaaatagatttgattcatgaagaaatcggagaataccccattttacttttggatgatgtactaagcgagctggatgattaccgacagtcccatttgcttcatacgatccaaggccgtgtgcagacatttgtcaccacgacgagcgtggatggcattgaccacgataccttacatcaagcaggaatgttccgtgtggaaaacggtgcgttagtgaagtgaagaaatgaggtgagcgattgtatattcatttaggtgacgactttgtcgtttcaacccgcgatatcgtcggcatttttgactgcaaggtcaatgtatcgccgatcgttgaagaatttctggacagacagaaagaaaaagtagtgccgtccgtaaacggcacgccaaagtctatcgtagtcacgactgagaatatatattactctcccttatcttccggcacactgaagaaacgtgcgcaatttatgttagaaatagattcttagcggatctttacaatgaatatattatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtgtgggaaatcgtcgacaacagtattgacgaagccctggccggttattgtacagatattaacatcgagattgaaaaagataacagcattaccgttaaggacaacgggcgcggaattccggtcggtatccaggagaagatgggccgccctgcggttgaagtcatcatgaccgttctccacgccggcggtaaatttgacggaagcggatataaagtatccggcggtcttcacggtgtaggggcatccgtcgtaaacgccttgtcgaccactcttgacgttacggttcatcgtgacggaaaaatccattatcaggcgtacgagcgcggtgtacctgtggccgatcttgaagtgatcggcgaaactgataagaccggaacgattacgcacttcgttccggacccggaaattttcaaagaaacaactgtatatgactatgatctgctttcaaaccgtgtccgggaattggccttcctgacaaaaggcgtaaacatcacgattgaagacaaacgtgaaggacaagaacggaaaaacgagtaccactacgaaggcggaatcaaaagctatgttgagtacttaaaccgttccaaagaagtcgttcatgaagagccgatttatatcgaaggcgagaaagacggcataacggttgaagttgcattgcaatacaacgacagctatacaagcaatatttattctttcacaaataatatcaacacatacgaaggcggcacgcacgaggccggatttaaaaccggtctgacccgtgtcataaacgactatgcaagaagaaaagggattttcaaagaaaatgatccgaatttaagcggggatgatgtgagagaagggctgactgccattatttcaattaagcacccggatccgcaatttgaagggcagacgaaaaccaagctcggcaactccgaagcgagaacgatcactgatacgctgttttcttctgcgctggaaacattccttcttgaaaatccggactcagcccgcaaaattgttgaaaaaggtttaatggctgcaagagcgcggatggcggcgaaaaaagcccgggaattgacccggcgcaaaagtgcgcttgagatttccaatctgccgggcaaactggcggactgttcttctaaagatccgagcatttccgagctgtatatcgtagagggtgactctgcgggcggatcagcgaaacagggacgggaccgtcatttccaagccattctgccgctgcgcggtaagattctgaacgttgagaaagccagacttgataagattctctcaaacaatgaggtcagatcaatgatcacggccctcggaacaggaatcggagaagattttaatcttgaaaaagcgcgttatcataaagtggtcatcatgacggatgccgatgttgacggcgcccatatcagaacgcttttattaacgttcttctacagatacatgcgggaaatcatcgaaaacggctatgtctatattgcccagccgccgctttataaagtgcagcagggaaaacgggtggaatacgcttataacgataagcagcttgatgagctgttaaaagagcttccgcaatcacctaagcccggcctccagcgttataaaggtcttggagaaatgaacgcgactcagctttgggaaacaacaatggaccctgcgaccagaacgcttctgcaagtcaatcttgaagatgcaatggacgctgacgagacttttgaaatgctgatgggtgacaaagtagaaccgcggagaaacttcatagaagcgaacgccagatacgtgaaaaatcttgatatttaaccaagaaagccttattttcgttaagaaataaggcttttttctcaaagcggcttctaaagcctctgaaaacccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactatgcaatgagcgttatcgtatcccgggcgcttccggatgtgcgtgacggtctgaagccggttcacagacggattttgtacgcaatgaatgatttaggcatgaccagtgacaaaccatataaaaaatctgcccgtatcgtcggtgaagttatcggtaagtaccacccgcacggtgactcagcggtttacgaatcaatggtcagaatggcgcaggattttaactaccgctacatgcttgttgacggacacggcaacttcggttcggttgacggcgactcagcggccgcgatgcgttacacagaagcgagaatgtcaaaaatcgcaatggaaattctgcgtgacattacgaaagacacgattgactatcaagataactatgacggttcagaaagagagcctgccgtcatgccttcgagatttccgaatctgctcgtaaacggggctgccggtattgcggtcggaatggcgacaaacattcccccgcatcagcttggggaagtcattgaaggcgtgcttgccgtaagtgagaatcctgagattacaaaccaggagctgatggaatacatcccgggcccggattttccgactgcaggtcagattttgggccggagcggcatccgcaaggcatatgaatccggacggggatcaatcacgatccgggctaaggctgaaatcgaagagacttcatcgggaaaagaaagaattattgtcacggaacttccttatcaggtgaacaaagcgagattaattgaaaaaatcgcggatcttgtccgagacaaaaaaatcgaaggaattaccgatctgcgagacgaatccgaccgtaacggaatgagaatcgtcattgagatccgccgtgacgccaatgctcacgtcattttgaataacctgtacaaacaaacggccctgcagacgtctttcggaatcaatctgctggcgctcgttgacggacagccgaaggtactaagcctgaaacaatgtctggagcattatcttgatcaccaaaaggttgtgatccggcgcagaacggcttacgaactccgcaaagcggaagcaagagctcacattctggaaggtttaagaattgctctcgatcatttagatgccgttatttctcttatccgcaattcccagacggctgaaattgcgagaacgggtttgatcgaacaattctcactgactgaaaaacaagcgcaagccattctggatatgcgccttcagcgattaaccggtctggagcgcgaaaagattgaagaggaatatcaatcacttgttgcgcttatcgctgagctgaaagatattttagccaatgaagaaagagttcttgagatcatccgtgaagaacttaatgaaatcaaagagcgtttcaatgatgagagacgcactgaaatcgtgacgtccggtcttgaaacaattgaagatgaagatcttatcgagagagaaaatatcgtcatcacactgacccataacggctatgttaaacgtctcccggcgtccacataccgcagccaaaaacggggcggaaaaggcgtacagggaatgggaacgaatgaagatgactttgtggaacacttaatttccacatcaacgcacgatacgattctgttcttctctaataaagggaaggtataccgttctaaaggatatgaaatccctgaatacggccgtacggcaaaaggcattccgattattaaccttctggaagttgaaaaaggcgaatggattaatgccattattccggtcagcacgtttgatgaggagcaatacctcttctttacgaccaaacaaggggtgtcgaaacgtacggcactgtcccagtttgcgaatatacggaataacggtctgatcgccctaggtctccgggaagacgatgaactgatggccgtccgcctgactgacggcaagaaacaaatcatcatcggaacgaagaacggtttgctgatccgtttccctgaagaagatgtaagacaaatgggacgcacagctgcgggtgttaaaggtatcacgctgacagacgatgatgtcgttgtaggcatggagattcttgaagaagactcccatgtcctcatagtgacagaaaacggctacggcaaacgcacaccggcttcagaatacagagttcaaagccggggcggaaaaggccttaaaacatgtaaaatcactgacagcaacggtccgttagtaactgtgaaagcaacaaaaggcgaagaggacttaatgattattacggcaagcggcgtgttaatcagaatggatattaatgatatctccactacgggacgcgtaacacaaggcgtccgtctgatccgcatgtctgatcaagagcatgtagccactgtggcgcttgtcgaaaagaatgaagaagagccggaagaaacggaagaagtataaacgaaaaagcgcagctgcaacaggctgcgcttttactatataaagaaatgaaaaaaagctttgacacatggtgatgatgctgatataattctttttgttgtctttttaatagaaaggcaagcctagcgaaaatattttttgaaaaagtattgacctagtaaactgaaaatgttatgattaagaggtcgcttcgagaggggcgaaaaagttctttgaaaactaaacaagac

SEQ ID NO: 123 - DNA, 64599 bp, Bacillus velezensis FL50S
ctttcatgaccatatcctttcatgcgaaatacttcaacaagatattaccatggaggaatgaggaataaggtcaatgtactatctaaaatggaaaaatgaatcatttgacctaattctttgtccttgtaattaagtaattaagcatttgagaagagagcttatggatgataaaccgatagaactgggaattactcggtagcgtttaaatgaattgaattggaaagattaagcgggttaaaatggttggaacagtcacattaaaggtaagattaatttgataaggagaaaaaattatgaaacaatttcgatttaaaggtacagtattattagataatgaattgtagtggggaaaagatgaaaatggtgtaattcaggataaaggtgcgttattaaccggaattgatatgttaacggaaaataatgtataatgtaccgggcggctttgaactcattgaaggtgatgaacatgaagaaatggaaatttttcataagatacatcctgactgaagagacttaattcaatgaaaattaacacaagtctatttatcctgttcttttttaggaggaaggtatgtcaattttaacaataattgaaatcgtgtgagtggcaactgtattagggttatttgcatggacttttaaaaaagagaaaaatactgatgaagatgtattaaattatgctagatatatgatttatttgcttatcgctgaagttgcattgtatgtcgtatttcaaattgtttaagtttattccaggcaaagagagatgtgaatcatgatagatgtcttaactaatatcttaaaaaatgacagactggatgaatacccattatttaaaaagttttgctctctcaaagaaaaagggttacgtaaagaatcctttaaagtattatcttcgtttatcgatgaagccaaaacgtgggataatcatgcacaacagaattttgcttgttggctatttgctttattagaaacatcagatgatattcaccatatacttgttcaccctttagaaatggatcttttaaagcctttgcttgaatcatggatgaagaataaccccgaagatccaagaccatacaggtggtatggtgtgtttttaaatactgaaaaccgtgtcgattacttaaataatgcacttagactaggaggcagtaatgaacaattatctttattaacgttaatcgatattcatttgaacgccttgtggtattcatttcatcacatatccgaagatttatatctaggcgatattaaagaagataaagcacttcttatcaagtcccgacagttgaacaacaagatagaatgtcaacaaacaagaaaaagcaataacgaacagcttaactattatcaagatttgttgaatgactggttgttgtttaaagaagaacaatcaaagggatttgttgaatggtgtgaaaataagggcagaagctatccttgggtcaaatcttattattacgaaaaatagcaattgcaagcatgtttgatttttaatcgtaaggggagatagatttgatgataataagatacgtaactgttcttattttatcggccatatgctctgcactggtatatgttatcaccttggatcaagctgaatatatcccttatcttataattagcgggatcatgttgacatgttattcaatttttgaattgccattgcagcttttcttaaaccgaaaacctagaaggttcaattttaaatatctcttaatatatacagtgttttcatttattgcatggctaatcatggcggttctctttgaaccttataacctaatagggtctatactagcgagttatgagatatatttattcagtgtattatttgctctgatcttttggctttgggactctattcttgtacagaaagttacgggttaagtaactgagctctaagtaaaaatacctttttatattcatcagttcttcctttaactttaatattatgcaatttggaagagtgagtaactttgaagtgaatggattgaggatggagagaaaaaacattgttgttgcggaaggctgggggaaatggcatcaatcctgtaagacctttatcagcagcggtttaagtatgttgaagggaagcggcttgtttaaattctaaacatttatatgttagtacataaattgtgagatttacctatatcaacacggcatgataaagaaaagggttgtttatgttgaattggaaaagaaatgaaaaatttatgtttgcaggaactttaattgcaatttttttgattttaatatttagcgtaatatttattaaaagagcgagccatactcccggtaaggatgatgttgctgtttttgggaaatttgcaatcagcagaccgccggtcaactatgatctatataataaacacaattccaagacggttttagaaaacgttacgggttactatgaattatctgactcccgagtttatgtgcaaaataattcagattttgttgtgattaataaaggaacatcatatgaaaaaagatcgctgaagagagcttcgaaaaatgataggaaaatgttaagcagaataaataaatttgagaaagaataaagaatttattaatcagaaataaacacaaaatgttaaaactccttacagttatgaaataatcattttattttgacgtattgaaattttttcttagaggagaaagtttatggatttacttaattggacttacattatatctacaaatataggagctgctgggttcataaggttattgtggttctcttatcttaataacaaaagtgaaaaataaagcagagcattaaagaatgaaaaattcgcattaagcaagttctttatgtttcttctccatcgctctgaaggaccttaatttgaaacatctaaccccttgtttaattcttttcctttttaattgaatatttgtacattaacatggcggcaaaatcatcacctcatcaatcaatttttgcataatcttcgtatatttcagttgttatccttattcatgctattccaatctagagaaaggatacctgcaggcgatattggaatgcagacatttgagttcaataaagaaatattcggccacgttatcaagcccccccaccattaactgaggggggcttcttattaatttggaaaatgcgttgacttacaatccatattcaaaaagatcaattgcttttagattcacctttctttttgctcctgacaatctttttgtcgactaaatcactttgtttaagttgaatgggttgttagaacatcatgtgatgcatctcctttaaaaagcatacacacatattagagggctgaaaattacccgtatgaattgggatacggcggtccacatggcttttcgcatgagccaacatgcggcaactggtcaacagctttagaaacttcatcctaacagggaagtgcggcaagcattgggaatataaaggaatataggcttacagctatgaagaatgtatgaataaccgtcagacggcgaaggaaaggcaatctccatgtgtcgtgactgttcggatgcgggagtatggaacttcccattcatccgctgttatgtcagagggacgaaaagacatgttttgaggaggaagcggaatgatcaaatttacacggccatcgcctatgaagaaaacatgcacgatgcaccctgaaaagaaatctgtcagagcggtttcgtttactgattttaacggcaattctgtaacagtaacactttgtgaaaagtgtctggctgatttaaaaaagaaagccgcaactgaatacaggagcgtgatcgaggagcgggccaaacagaatcgcttcaagattggtgatcatgtgtatttaaagcatttgggagtagtgggcgaggtgaaaaacatggaaggtgttcaagcggcaaacaggacagacacagacggaatccggatggccaccccaaaggaaatcgcagaatacaaaaagcaggagaagcaataacaaggaaaattctatcagcggtattactaacgggagcggcggccgttgcgccgtctgtcgaagagatcgcgcagttattaggggttaaaaaagaaactgtgcagaagaacattgaacgttcccacctgaaaatgaaaaatagagcagatcacagcctattctgtttagcctgaataggttgtttatttattgaaatataagaaaagttttcaaaaaaatctttaaatactgctatttttataggtataatggtattgtttattgttgcaattcagagaattcaaagaggatgatgttaatgtacaatcttaaagaacgcgatgcaattaaacggttcttaaatgaggaaaccgttaatacaagcgaagcaattgaaatattgggcttcactcgtcaatacctaaaccagatagttaaaagaggggaattagagccgatgaaagaaatgccaagggacaggctttttataaaaggagatgttctgaatttttgagaaatagtaacaaatgagctctcgtagataaagggtactttttatgttctacgataccttaaagagctttttaattaaagagaactaaattataagccactggtataaaaaagaggtgtgaaaaatgaagggtttttttgtgggtttctggagaagggtatacaaacgaaagaaaaatgaagttgagaagataccctttgatgagattacagaagtaacaaaatatcttgagtactttggtacaccatataaaaaaggatctacaatcaagcatgaagaagatttcaaaaaaaagcttaagcaagaaaagcttaaagaaaatcagctaaataaactaattaaaaaattagatggtagtctagaagtttctaacgatacttctaacttaactccaattcctttcgctataaatacagcagtaatgacaagtacggttagtattattacaagtttaattgctttttacgctgcaacagctaattcattttcaaagatagcattagacatagatgaaaagaaaacaatcaagccttcagaactgcttcaaatgattatagatgggggattacacttaagttctgtggctgttttttgtgctattattctgtatttcataataatgggaatttggcatcggatcactaaaaaaagaaccgaattttcatcaaaattacgttgctataagatgctattggaagaaataatcgaagagaaatcagaaactgaagaaaagaaaaacggacaaacagaagatataaaacaagcaaaacaaacaaaaaagaaccgaaaaaaaagaaacaaaaagtgatactcatttgtcttcgtctaacaaattctgcaaatggtcccattaacttaaactgtaactgataataaggagggggtgaggaaatggatcgcagaaaactagtttatagtattttaaaggaaatagacaaaggcaatgaaccaagatacgctgattataatgttgatcttcagttttttggtgaagttgtagaaatgatgcaaagcaaaaatttaattgaaaatgcaactgtcactagagatgggtaaccctgtaaaaatgacactactaaatcatgtgaaagttacttttgagggcatggaatatcttgaacaaaataatgattgggctataacatacaatacaattaaagaattaagagattggattaaataacaccatggcatcccttgggggtacttattttatgaaagtttctttcgttcgacaaattttgcaaatggttactttatcattatctttcgtcgataataaggcggaaggagatgattaatttgactaatagtaatcaatatatcgaagcggcaaaaatagcagctgaagcagcatcaaaaaatactgagctaacattaaaagtctcaattgttgctgctataattgccttattaggaacaggtatctcagcatatatttcatatcgtagttctagaaggacaacattaattgaaactataagtgctcaaagaatacaatgggtcaatcgtttaagggataagtttgttgaatttaataaattgattaatgagttttcttattctatatatgaaagtgttgaaaaaaagtacgttacaacatttgattataaaacaaaattccatgatttgagagctgttggaaatcatataagtcttttgttaaacccgaatgagaattattcagaagaattatcaaatgaaataaaaaaaatgtttgatatattgcttgagcaagacgcttataaagttgagctttatcaaaattgttattctagaatagaattaattcagcaagttattttaaaagcggagtggaagagaattaaagaggaaacaaaaaaaggtagagaattaactgaatcagaaattgaaaaaatatataatgaaaaggcaatcagtatgaaccttaaataaggatagttgggagagaagatattggataaagaaaaattgagatatgctattgctaaagagatctatgaaggtaacacccctttgacagaaaaggactttgaagtttccgaagatcaatttgatgaagcagtgaacttcttaaaacgagaagaatatttaatcggtgttttttattcagataatcgtccgcatttatacaaaataggtcctgaactaactgaaaagggtgaaaactttttaaaagagaatggcgattggtccaagacttataaaactattaaagaaataagggattggattaaataaacaagagtatcctgcaggtgcattcgtcttacggttaccacctatttatgaaaggcgctttcgttcgacaaattttgcaaatgatttctttctccaggtgggggaggtgagttagattgaaagtcgcattaagaatccataatatgagtgatgattctttaacagataagaaatgatttacgataattttggtgctccaatcccacaagttggggaaatcatttcggtcgaaggtcatttttatactgttgaagacagattgtttgtgtacatgacaaatttagatattgatttacagattattttaagatgtaaacaaaaagaatcaaaagagagaagttaaggcagatgttttgaaattatagtaactgatgcgagggcacccaaataggtgccttttttatgttctctgtaaaccgattccggtaaatctcgggaaaactattggcggttaacggtctgagtgcggccggtgaatgtagatggccgaaaagcacattcaggcatacaaggattacgccaaaggcatgaaatacaaggaccttgccgagaagtacggggtgtcggtgaacaccattaaaccgtggaagcagcggcatggttgggaaaggaaaaagggtgcacccactgaaaaaagtgtgcatacaaaaataggcgggcaacccggcaacaaaaacgcattaggaaatagcggcggggcggctccggcaagaaatcaaacgctgtatcacatgggttcttctcgaaatatctgccggaaattaaaatttcagctgatttcctaactgtcacggaaaacgtctcgcaggaaatatattgactttcatcctgtttgtaatgttaattagaagatgtatacaaaaacattataatgaggaggtctggatgtgaaaaataaagcgggaatacaagttggactatgcattggacttttatgtttaagctttaccggtttcaatcctttattcggctcagcgtatgctgaagcgaagtctatagaaaacacaaaaatgacaagctgtataacgaatcaaaaatttgttcagcttgagaaaaaatttgatgccaggcttggggtttatgcgattgatacggggtcaaacaagacaattgcctatcggccgaatgagcggtttgcttacgcatcaacttataaagttctggccgcagctgctgttctgaaaaaaagctcaaatgaaaaacttaatgccatcatccgctacagcaaagacgatttagttacatattctccaatcacagaaaaacacctggatacaggcatgagcctgaaagaaatctcagaagccgctgtccgttacagcgataataccgccgggaacctattactgcagcagcttggcggccctaaaggtttcgaaaaatcactgaaacagattggggatcatgtaacgaaagcggatcgattcgagacggatctaaactctgcgattcccggggatcgtcgtgacacaagcacagcaaaggcactggcaaccgatcttaaagcgttcactttgggtaacactctcacgactgacaagcgcacgatcttaacggattggatgcggggcaacgctaccggcgacgaactgattcgggcaggcgctcctgcaggatgggaagtcggcgataaatccggagccggaagttacgggacgcgaaacgacattgcgatcgtgtggccgcctgacagagctccgattgttttggcaatcctgtcaaaccgatttacggaagatgccgattatcataatgctcttatcgctgaggctgcaaaagtcgctcttcatgatcttaaataaacattgccgttcattttttatggacggttttttatatgttgagaatgcggtatgcgggtttcgatgttataatgtaaagccataaaatgatgggaagagggggagtttcgatgcattacataacggcatgcttaaaaatcatcagtgataaagaccttaatgaaataatgaaggaattcaaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaagcacacaaaagacgttcaaaaacaagaattaacggaagtagaatggttaatgaaaagcaatgtgaatgagtaaaaggctttgtctgttgttggctgactctgccggcaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagctgtttgctgtcaagacctgtataagcgtcactcattaatgggagcataattcctccaaaactggtgccgcggataaataatacgacggaaatccaaatcatacttgtgttatcggtgataagaataagcgggatagatccaatcagcgagagaacaagactgaccgtaaccacgtatttcgcaccgatcttatcaatcatttttccgatcagcggacgagtcacgagcattccgactccttgagggattaaagcgagtgctgctccgactgccgtgaaatgacgaatgtcttgaaaaaacagcggaagtattaacatcggccccatgatggcaacattcgctaagaacaacccgatcgaagatgctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgaactttgttgaatggttcaaagtctggaatggttttcatcataagcggtgcggcaaccaaaatgatgaacacgttgatgtaaaaaatccaatgccatgaagcgccttggacgatgaagcctccgatgacaggtcctaagatcgggccgaagatcataggggtgctgacgattgccatcacttttcccaggttttccggacctgccgttttaaccaagagtgttgacataagcggagtgataatgccggcgctgaatccttgaagcaaacggaagaagatgaagctggaaatgtcccggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgtcgtgttgaagtctttggtcagtttgtcgatggcgatgtttaccatcgtagagtcaagcatgggagcaattgctcccagtgcaatagcccaggcggctgtgagaacttcttttggcagcaaaagttcctttcttttatgtgttgacatattattctcctctcaaaattgctgtatttgtttccttgtcaacaaaataatagagtgattttgtttctttgtcaacaataagaaggatataaaaaggcagcccgttttcatggagcggggctgcctatggttttattccgatttcatgtctgcaccaagtttctttatttctgaatccaaatgcctgctgtatgtttccacgaagctcagcatcgtgtcaaattgttcatcagttacttgttcaaacacgattttgtcccgttcttgaaactctttgtgcaattcctcgtgaattttataaatgacttttccttgctcggtaagcctgaaatagatttctttcttgttaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatgacccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtgttttttcgagtatgtttctttccgtattcgttattagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacacttttgcggttgcgcctagtggatacgcatctgacagaacgctggagtgagcttcgggttcccagtaaaatacgccggttcctttgccgttcggaacggctttcaccagttttatggtgtcttttatggtccagtaggaatctttcggattattttcatctccgcccagttcaaccaccatgacttccttgttgtagcgtgaggcgatgtcattcaaattagatgataaatggccggtgagctcccagtacggcttaccttcccaatagggatagaacgaaacgccgatgatgtcggttttccctccgtttttaaagaattgatcaaaccaccatctgaataggctgttgtccgtgccgtgtgctaaatggctgattaccttggtggccgggctgacggatttcacggcgtcatagcctttgttcagtaagccggtcaatttgctgaaatcgctcgtgctgccgtcgggcagtaaaattcctgaattcatttcattccctacttgcacccaatcaggggagataccgtgatttttaagttctttcatgacatcgtacgtatggttatacacggctgcctgaagctggctgtttgaatagccggtccattggttcggcttgatctggtggccgggatcagcgaacacatcactgtaatggaagtcaaccattactttcattcctaacgcttttgcccttttggccgccgcaagtacgcctgctttgtcactatagccgagcatggtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatccgcgccataggcaaacggggcatccgcttttgctttaggagacttctcaaagaatgtaaaagcggtgaaaatgagagaaagacagattgtgtttacaaatacacgtttcaatcggtttttgaacatcacaatacctcctgataaaaaagattgttgattgatttcactctgaatgtttcagctgccattctccaataacgtcgtgaaacgctgaaacgcctgaattccttcgggtgtcattttaaaaacgcctgcatcggtcagcgcgcgtaaaaatacattcgcggtttctctttgtaaaacagcggctgtattttccggtgtcacgtctttatccgctttgatgttttcagcccacggaagatgaatgtctttgatgtcatgaggttcattcagtaaatactttttcacttctgccagctcatctttcaggcggggaggtaaaacggcgagccccatcacttcaatcagaccgatattttcttttttgatgtgatggacatcctgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcgtctgaatattcccgccacttttcaaaaacataggcagcggcatctgtcagcaaatccggatcttttgcgcgaaggcggatcactgataccggccactttacggcttcggcctgaacgtctggaaaatgacgcatatgaaaagggtagagggaacccgcttttgccatgggaaactcatgggcgccgccttgataatgatcgtgtgaaagaatggaacctcctacgatcggcaagtctgcgtttgaccccgcgaaataatgcgggaaaatttccgtaatggccagaagccttctgaagctgtcgcggctgatgttcatcggcttgtgtacgcttgaaagaaagatggcatgctcgctgtaatacgcataaggagagtattgaaaaccccactgttctcccgctaagtcaagcctgatgatgcggtggtttgaacgggcggggtgatgcggtgttccggcatacccctcgttttccatacagagcagacatttcggataccggttttccggactgttttttaccgcggcgatgtctttagggtctttttcgggctttgataaattaatggtgatgtccaattctccaaaaggtgttgttgagcggtacacgatattttttcgaatggcccgcgtcttaatatagtcgttgttttgactcaatctataaaaataatctgttgcttttttcgggcaatctgataacaatttgctgaatgcggcattgatcagagaaggggccggtgtgattacgtccatgattctgcttcccagcatgtctctttcagccggcgtatcgtttatgattgaccgttttaccgcgtctttcaccatttcgtccacatagtgaagcctgttttgtttcttgatacgtttcggttctgcataatccgtcagtccgagcagatcgagaagtctgtttcttgtataaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggacgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcggaaacatgaacataatcgcggatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaagcggtatcgcaccacttcagcattttttctgccatgagttttgattcgccgtatgcactttccggcttttccggcatgtcttctgtgatgggcgctttttcaggttcgccgtaaacagcggcggatgaagaaaacacaatgtgtttcacttcgaattcctgcatgacctccagcgtaatttgcgtaccgtacacattattattgaaatatgaaagagggtctatcattgattcgccgacaagggattgagcggcaaaatggagaacgcctgttacgttctccttcgcaaatacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcccggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcgtagtcatcacgtaacgaacggtgcgacgcattcatcagctccccgaacgttttcaaatcattcgatttgagagcttccgccgctgagagggtccgctcgttttcattgaccgcgtgccgggctcttttacgcaaagtttcacgggagagaagaggttcgagttcgttgaattcttctcccgtcaattccgcaagtgatgcgatattttgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaacagaatggccatgttctttttgcctttttgcactgcgaattgatccataatccctgaattcacgcccataaattcattttcgactctttttccgataagcgccagttcagtatcggaaacattcaggctgaataactttcttaaaatggaaccggttaacatttcaatggaagcagaggagcttaaaccggctccgtttggaatcgtaccgtgaaaaagaatatccattccgctgtctatttggccgccggcttcaagaaggtaatggatcatccccttcggataattggcccagccgtcttcttttttgtatgcagtggcggaaagatcaaggcagacaatgccgctgtcaggaaagttttctgagtataaccggatctggtgatcttcgcgttttgcgcatacggcatatgttccgatcgtgatcgcgcatggaagaacgtgaccgcctatataatccgtatgttccccgatcaggttgatccggccgggtgcgaaaaacagttctccgttacttctcttgaaaatgtcttcgaatcttgatttcaaaagtttggcatccatggtaaacctccgattctattttgaggtatgctccagtatgaactgaatggctttttgtgaatttctggtgagactgatatattccgctcctttcgttgcgatgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttcggtcagtgcgttcgcaagcatagcgctcgttcccgctccggcgcacagcactaacacattggtgccgtgttccaaggcggatgaggattcctgaagatttgtgctgatgacggtggccgcgtcttctgaggcgccggccattacgggctgtatctcccgggatttttgcgccgcggtttcaggttcggtatgttgggcttcttccgccgctaatactttgtcataagctttacagaatggcaggtatatcaggaaatcgacaataattaatacagccgtcagaacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaaccgcggatgcttttccgactgctttcaattgcttggatttcgcgaaaagcagaaagataaacggaacaacaagggttgcgccggttcctcccattgtgccgacgaagttcccgagtccgacggtcagcacgttggacgcctgctcgccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaacggcgataagagagaggagagagcctccgcaaacgatacattcagcgtattcctgatcaataaatcaacgatcaccatggccaaaacggaaaaagcgaacggaaaaacatctttaaatgtttgtgaaatggtacccggtacttctttaggcattttaatcgtaatatttttcagcacgcagaatctgtaaacgttcaccgttatgaaagcggatacaaaagcggctaaaagaccttttgtgccgagatattccgtggagaacccgccgtcgatttgagtgacgcttaaaatgagaaacccgacgactgaagcaagcatcgctgaaacggggttgatccctttgtttttcggcatttttcggttcattgattcactcaggcatttcgcacttgttgccgcaacgatcagaccgagggcgcccattgaatagttataaactttccaaagccattcagaaacacttttaggccaagtgaaacccaacacttccggcacagcggcggtgaggatgaaaatgctggcgaataaaataacaggcatggcagttaagaagccgtcgcggatcgcgcctaaataaatgtttcttgagattttttcgaaaaacggttttcccttttcgatttgcttgatgataccgttcatttttccactccttatcggcggcttcggtagagttctataaaatcctgaataagatcacggagcaaaagggttgtcatcaagtggtcctggccgtgaacgaaaataaaccctaattccatgtccttgccgtcagcttcttcagctaacattttcgtttgcgcattgtgggcgagggttaaattttcatcggcgcttttcaatgctgcttccgtgttttcgaagtttccggcacggacttctttcaggactttcaataaagtgctcctggcgtcgccggcataggcgacgatttcaaaaccgagcatctgcaattcttcctttgtcatgaaaaaaacctcctaaagacggcacacatgatgaaaagagattcttttcatcatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaaatagtcgattcttgccttatccataatgatgccgtcttcaaactcatctttatagcccatgccgttttcggtaatgtaaattttgttatattggggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgttgaggcttttttcatcacgtcaaagtcactgtctgaaaactcgtatgaagcgccgtttgcctcacagatttcatccagagcacgcatggtttcctcagaataatagccaaggtaggtggcatcgaggaggaatctcactgataacgcgtcatccagaaaacaggcgtggcggtcttcttctgtgccgctggcgggatattttgtttccaatgagtggacgaccccgatttctcccggataaccgccgtctttaaaaaggttgacggtcatcgcatgcgctaccatcatgtgatggaggcattgaatgacttttgtgatatcacttttaacagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgttgcgtttatggcactctgagaaaatacgatgatagtaatcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacagggcctttgccgccttcttttgtggcgccttccgcttgatatgccgcagtcgccccgccgaaaataaagtcatgaggtaatttgagcattactgaatcctccttcgccaatgtgtgaattggagtttgttaatgtttgtaattgttatcttttgtttaatagtaaacgcatacatttttgttgtcaatagcttcataaagaaataacatctgtgtttatagaggttatataagtttttcgttgttttacatgttaattatgttgtttgttaatgtttatttttgttgaccggattgccgcagtatgttagattgtgtgtaaagttgaggggatgattgaacatgttaaaaaaagagcgacttttaaaaatcatcgatatcgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactcggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggcggcgacttccgaaaaaatactggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaattcaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgcgccgaaaaccatttctgatgatgacattttcgttaacattcacgggagaacaaacagtgaaatcctgacgtattttatttccggcgatttaacaaatgaagaaatcaagaagctgtcttttgaaaaagaagcttactacagagaattatgccttgaaaacaaagacgaattaaagctgacgaagggactgaccggcgtattgaatcatctgaaaaaatctgaaacgccgatgaccatcgccacggctacggtaaaggaaaatgtcgagttttactttgacgtctttcatttggatcagtggtttgattttgacaaagtcacgtttgatgacgggagcttccccggaaaaccggccccggatatttttctcatcgcatcggaaaagttaggcctcagacctgaagaatgcttggtcattgaagatgccttttcggggctcacagcggcgaaaaaagcaggtgcgggcaagattatggccattgacccgcacggaaaaaaccgcgcgctatttgaagaaaaacagctggcgggtgacgggatactgacagatttcacctcgttttttgaggtgattgccggacattctgtttgagagatgcagttggattgagagtgctttatgtaagatcttttgatgctatatccgaaaattaggatgttaaaaaacgctccctattcatatatgcaacagaaaccgaagtttttgatggggtattctttagttggcggtcaaactaaagaagtggttcaaggacataacagaaggagtgtgctaaatgaatatatttagaataagaatctgctttggatagtggaatcgcaaaaaaatttaggagctttgcaaaacatttcaacagctgttcttaataatagggtttacagtgttgaaggtagaaaaagtcctatttagcaagccctcttttttaaaaagagggctttttttatgaggtgcttattctttttcagttgcgcttttgtttttgtataatgattttctcattgaaggcggcattttttgcatcagaaaggtgttcgccttaattgaaatattggctgaatttatagattcgcagagataagggagtcgtaaaagatatgccgtttgcggatttcagcctgtcttttgagaaggatcattcttcaatgacgcttatttcccccgtgccgaaaaaaagtgaaacacgttctcctcgcttttcataggttttgataagtccttcctgccctttaagtttccagcctttttcggctatttccaattggtataaaccgctcggaccttcttcttcttttgcgaaacggtatgtatagtttgaaacgtattttcctttttcatattcctttgttttagtgtgcatagcgaataatggcaccgggaaatcagggtgagaaacagctgctttatatcctcccaaaataaataagctaaataacaataatataaaaaaccacagaatatatttcataaaacctccttatgtcaattagtcggtgcattttaaaaaaagatacaccgcatgattgggttataaaagcgggtaagaagataagaaaggagagagacggatggaacttgattttgtgattcgtctggcggttgcgggtctgcttggggctcttattggattggagagagaattcagggcaaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggcgtcggatttttaggagccggcacgattattttgcagcggcatgtcgtgcgggggcttacgacggccgcggggatttgggctacgtcggggatcgggctgacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatattctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatcttttttacactttcacatcaattgagtgtccggcagtcgggtgctgggacggcagcattttcactgtttcttccgccgcagcctgtgcatgctgcaggaccgtttttgttaaagcgatatttacattctgcgccagagatgcctgatgcattgcgattgataacgcagggatatccatagcttccacctccttatcccttcatatcggcggcgtgctccgattatgaagagggctggcggtttctttttacggcccattctaaaagtgcggcagcgcataccccgagggtataggcgaaaatgtcactccagacaaattgccagccgaggatcagcccgccgagcgtgctgcttctgaccgcgtcaatccacggcgcgtgatacagctggctgcattcaatcagacagcaaaacgagaggctcaaaattgcggctgtttccgtccggatgtgccgaaataaaagcccgaatcctgtaaaaatcatggccgcccacagggcatctcctaaataagcgtttatgatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacgacggagaagctgtctatgaaaaaaacgacccgggaggccgtttttttgcgttatctggcttttaggttgacatgatctgctttttgatcactgccgatgacgaagcggagctcatactgccccgtatggtagacgtaatctgtttcgcccgtttctggcactgtcaggattttgtcagcgctgccgatttgtttgcttaagacgtcaggtgtgacgctgccgaggtttaagcgccgctcgacccccgttccgaaatagcgtatttccgagatttttccgtttttatgataggaaaatccatacccggggtttcccatgttccagctgtataaatcaaatggattgcggctgtctgctttttgttccggctcgccgattttattgtaaacgtcctgtcttgtgctttggttgattttcaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaacgagatgttttagtgaaaggccggttgggaatcatagaggatgtatagaggggtacagaaaggggaaagaaaatggctgatacaaagaaagttacaatcaatggggttgaaatggaagcgccggacggccaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcattgatacgctttcgtccgatgtaaaaaaagcgcaggttatcggcatggacaacattttgcacaaccatgaattgtactgtacggtctgtgattacaacaatgggagctgcgaaatacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaacgttaagcattgattgggagcggaaacgcccgcgggtcatttgggatcaggatgtgccgatcaatgaatcatcatgtgtttcctgcggacattgttcgacggtatgtccgtgcaatgccatgatggaaaaaggcatggaaggcgaagctgggtatttaacaggcattaaccaagagacgcttcggccgatgattgatatcacaaaaggcgtcgaaaccggatacggatcaattttagccatatcggatatggaatcggccatgcgggatgaaagaatcaaaaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcgtttatcacatcttccaaatgcacgaatgaagaatcatacgtgatgcagaagcttgcaagagccgttatcggaacaaataatgtcgacaactgctcacgttactgccagtctcccgccacggccggattgttcagaacggtcggatacggcggtgattcagggtcgattacagatatagaaaaagctgagctcgtgctgattatcggttcaaatacatctgagtctcaccccgtcctgtccacacgcattaaacgttctcataagctgcacggacagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagcgtatgcgcactgtgggcgatgggggtcacccagcatatcggaggaagtgatacgagcacggccatttccaacatgcttcttgtgaccggaaattacggcaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatggggcttgtcgactccaatatcaaccatgttcatgccgcctttgaaaagcttgatttcttcgttgtgcaagatatttttctctcgcggacggccgagttcgccgatgtggtgctcccggcaagcccgagtcttgaaaaagaagggacgtttacgaatacggaacggagggtgcagcgcctttacgaagtgtttgaaccgctgggcgattcaaagcctgattggcagatcattacggacatcgccaaccggctgggcgctgattggcgctatgaacatccggcagacattatggaagaagcggcaatgctttcgccgctctacgcaggcgtcacttacgaacgtctcgaaggctacaattcactgcaatggccggtagcagcggacggaaccgattcaccgcttttatttacggacaagtttccgttttcagacggcaaagcgattctatatcccgttcagtggaccgagccgaaagaatttgatgaagaatatgatatccatgtgaataacgggcggctgctcgagcattttcacgaaggaaatctgacttaccgatcaaaaggaatatccgaaaaaacaccgagtgtgttccttgaggtctcgcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgccgccattaaccttttgacaagcagctatgcggataaggataccgatacaccggcatataaagaaacatcagcgaagatggagattttgaaaaaagaaggcgttaacccgcttccgaaaatcaatttccgttacggaaacccgcagccgcagatcggtgtccgggttgatcggaaatgggcgcgtcaagattatgtatttccgggagacgccgtaaaaagggggaaacagcagaatggctaaagcaatcagcggcatccgaaaacagaccgtcacagaagaagacaaacgaaaaaaggacttagaagagatcgagacggctcttttacgaaataaagacgcgattttggaatctctgcacattcttcagcacatgaacgagcgcggcgttttggcgcttctgcgcgggctcttcggccaaggagacaaagtgatggatatcctcgtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacgggttattttgatatcgtccgcgctttaaaagacccggaaatcaacaaggccgtcactctgctgttttctttcctgaaaggcatgggcgctgatacggacgatatggaaagaaatacgcagcctcctgaagaccaaaagcagcaccagaaaccgcagacgaatgagtgaacatttctcccgagcctggccgaaggctcgggttttttgtgcacttctgttgttttcttgggagaaatttcacctccggattcatgacttttgttgtgttatgttaatagttaaggttatgaatagaaaaaaattgaaaatatgtgctaggataaaattcaaggtgcgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgggaaagccctatatactttgatgaagaaacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgcgtcttgaaggaatgggagccgagaattaaagacattaccgatcatctcctgaaacaggcaaagaacaaagggcggattgatatcgttaaagatctctcttaccctttgccggtcatggtgatttcagaattattaggcgttccgtccgaacgtatggatcagtttaaaaaatggtcggatattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagacattatttctattttgataaaagaggaagaagagggggagaagctcacgccagaagatctgatcccgttttgcaacctgcttttagtggcgggaaatgaaacaacgactaatctcatttcaaatgcggtttacagcatattagagacgcccggcctttatgaagagctgagacaggacccttccctcatcgcgcaaacagtggaagaaacgctgcgttttcgcgctcccgctccgtttgtcagaaggacggtccggcacgacactgaactgcgcgggcgccgcttgaaaagcggagagatcgttctctgctacgttgcatctgccaaccgtgatgaaaacaaatttgagaaggcgggcgtatttgatatccatcgccaatcgaatccgcacctttccttcggattcggcgtacacttctgcttaggcgctccgcttgccagacttgaagcggaagccgcactgaaaggaattgtaaaagccttttcacaccttgagcccgttcggattgagccgatccgaaacagtgtcatgtacgggctggagtctttagaagccgagataaacgaaaatgagggagaagaaaaaagatgagaaaaacacacatcgccattattaatgtggccgctcacggtcatgtcaatcccacgcttcctgtagccgaggaacttgtcaatcgcggatataaagtgacattcgctacgactgaggaatttgaagcttccgttgccaaaacgggtgccattcccgttttataccgcacaagcataaaggcggacccgaagacgataaaagaacgggtaaacaaaagtgacgcgtttgtgatgtttctggaagaagcggttgaagtgcttccgcagctggaagagctgtacaaagacgaccttcctgacatcgtcctgtttgattttttagcgcttgccggaaaattgtttgcggataatggcggcatcccggccgtaaagttctgcccgagttatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggggaacgcacaaatacgggaagtctggaaattgatgcagccgatgaccgtccgcttatgctcatctcactgggaacggcgtttaacgcctggcctgaattttaccggatgtgtattgacgcgtttcgggactcggactggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggtcaccgcaaagcgtgtggatgaattggggcttggcgtgcatctgccgccgaaagaagtcactgtggcccgtctgcaaaaagacgttcagaacgtatacggcgataaaaacatcctcagccgcgtgaaaagcatgcagcagaaaataaaagaaaccggcggccctaaacaggctgtttgcgccattgaagaatttttgaaaacggcgtccgtcgaaaattgattaggaaaacaggcagcaccggacggctgcctgttttgttatatgtttttcttcatgccgcatctccggcattccctcaaaaattttccgcccttcactgagcttttaaacagcgtgtagtcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgcccggttaatgatacagcaactgcacgggggattcaacgggagcatagcttgattttcccggctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcggtcatccgttccctccaaggaaccgtatacctggcggaggatcaaatggaacccgacgtaagaacatttgccgagcaaaaagccgactgggtgatattcaccacaggcatcggtacggaaacgttattgtcggtatcggaaaaaatcggtctgaaagaagaatttttagcggccgttcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagttatgatacagcttcatggcgaaaaagcgccggttttaacggagttccttgagaaaaacggagcggaggtattccctgttctgccgtatcagcatattccgcctgaaagggagacggtcgataaactgatgggagagctgttaaacggagaggtcgatgccgtatgttttacgacagccattcaagtgcgctctctctttgattatgcaaaagaaaaaggatccgcaaaagaattgcagcaggcattcgaaaaacatgtgcttgccgccgcagtcggcaaagtgacggctgaagcgatccgggatgaaggggtaaagagggtccttgctccggacattgagcggatgggagcgatgataattgaattatcccgttactatgaatctctgaccctgtcataaaccaccattcagcagggaaaaaagcttacgcttccctgctgaatttttttaattgccagtgttccgtgaaaagggaaggatatgtcaaggcgctgagtatgatgcatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttctagcgtcgggatcatactgagtttcatactggacgtcaatatctgccggacggcctgcttaggcgttcctccgagagagagaatcagctggatttcttctttccgcaggtctgcttccgaactgagccggcttaaaaacagacttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgaggcgatccgcatttttttccgtttggcgacattgtgcgaagcggccgtgagcatgagaagcaccattaatatgataaatatcgggtgatcaccgcgaaaaatcagcgacagcacatagcctatgatgagaagctgaatgacggccctgacggttgcgacgatcatatccttttcgacgccggctttaaaagatttagacaggaataaagcgataatgacaaatatacttgttagtaacagtgaaagatcattcatatcagcacccgctcccttgtaaaagcgcccgggctttttcgtgtttcggttccttaaagaacgttttcgtttccgcggtctctaaaagccgtccctcagccataaaccataccgtatcggataatcgttccgcttgttcaaggttatgggtgatccacaggattgtcagctgtttttgccgatggagtttcgtaatcagtttctcaatggtgagaacggatgaggggtcgagcgccgaggtgatttcatccagcagcaggatggacggcagtccggcgagagttcgcgctaatgagagtttctgccgctgacctccggataattctttcgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagaacttccccttcatcaggtgtattcatcagattgcaaagtgacagcaatgtgctttttcccgcgccggaaggccctatcaacgccgtgatagaacctttttgaatatgtccggttacacggcttaggacatcaaaggacgtattgttttgttcaaagcgtttgccggctgacagaaaagatattgccggaatttcttctttcatataagatgacacctttcgtaaaaaatcaggaaccggtgagattggctgacgtttgctccgccgttttctgatctgtctgccgggaagcgaatgtatgcatgaccattcccgcaataataatgaacagtccggtaaatgaaagaagtgacggaaacgccgcggataaaaagacgatttcgccgatcagtgcaaaaagaacctctccggactgcgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctatgccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgacgacgaccggcgccacgctgaatagtatcgtgcggccggacagagaacccgcatgctgaagctgaatcagcccggctccgatcaggatgatgacggaagtaaccagcgaaatcagcgggatcttttgtctgacggaaaccgggcccgccggtgaattttttgtttcgcagaaaaacggcgacagaagcacacccgcgacaattgtaatctgccacgtgccggcgatcagccagccaggcccatatgccgccgcaaacgtaatcggggcataaaaaagcacgaacccggtaaaactccacttcagccaaaaaaacggttttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcagaaagaagatattcaagtgctttatttcgaagatgacggcagcattccgaataacccgaatcttccgcttgttatttataaagcggtatttagtgaagaaacggtacagaaagcagagtccgtcctcagccggcacgattggtcgaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggccggcaccggacataaaaaactgtcgggcagttctgattttaccgtgatcggagcttatccgggcggccggcagtacgatacaaaaacggagaaaaatgatagaatttcagaagaaatcagccgtgtcccgctcccggaatgtgacccctttacgggaaaaacgggcccgcttttaaaactgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgccatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaaccgttgtgaacaaatacccgactcaccaaatcattacggaactgcaccgccttgcagccggcaacgtgtctgaacaggctgttgctatgccgctggaaaaacttctgaaaggaaaagacgttgacattaaaatcgcagaagtcaattctttctcagttgataagaaagaagttgccctttctgacggttctaagctgacttatgacgcgcttgttgtcggacttggttctgttacggcttatttcggcattcctggactcgaagaaaacagcatggtgctgaaatctgctgctgatgccaacaaagtatacaaacacgtggaagaccgtgtgcgtgaatactctaaaacgaaaaacgaagctgatgcaacgatccttatcggcggcggcggcttaacaggcgtcgagcttgtcggtgagcttgctgacatcatgccgaaccttacgaaaaaatacggcgtagacccgaaagaaatcaaactgaaattagtagaagcaggtccgaaaattcttcctgttcttcctgatgaccttatcgaacgcgcgacaaaaagtcttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagcctcggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcacacagaagacattgccggacttttctcggcaatgttttttttttttttgcataaaaatgttaatggatacaattttctgaaaaataaaataaaagtgattgatatgtgagaaagaggaagctaaaataaaaaagaaccattttgttaacgttaacattttttaagagggaggatgagagtgtgaaagcttttatgggtgatgactttttactggatagtaaaacggccgtaaagctgtaccgggaatacgctgaaaacatgccgatcattgattatcactgtcacttaagcccaaaggaaatctatgaaaataaaaccttcgcaaccattacggaggcatggctttacggtgaccactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacagccgcggcaatttggaaaaaaacgaatgagctcctgcagggagacgggtttggcgcaagggatctcatactgaaatcaaatgtcaaagtcatttgcacaaccgatgatcctgccgatgcgctgacataccatgaactgttgaaagaaagtgattttccggttcaagtgctgcccggatttcggcctgacaaaggtctggacatcagcagcccgggttttgccgattgggtccggtcgctggagagcgcttccggaatggctgtcaccacctaccaatcgtatttggatgcgttggaatcccgcgtccgcttttttcacaatgccgggggaagagtgtcggatcacgcattagatcaaatggtttatgccgagacgaccgaagaggaagcggcccggatttttgccgccggattaagcggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaatgtatcgcaaaaccgcttgcccggctgttagattccgccgaaaaaaagcggcaattgcctaaaacgattttgtattctctgaatccgaatgacaactatattatcgccagcatgatcaacagctttcaggatgggaaaacaccggggaaaattcaattcggcacagcctggtggtttaatgacacgaaagatggaatgcttcaacaaatgaaagcgttatcaaacgcaggtctgttcagccgttttatcgggatgctgacggattcaagaagtttcctgtcctatccccgccatgaatacttcaggcggcttgtctgcacgctgatcggcggctgggcggaacaaggcgaagcgccctgcgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgagggaaattcaggccgtacttattatttggaagtattattcttgcggtcatgaccgtattgatttttgtgtcaccggacgtgagcgtcacctggaaacttgtgtacgcctatgcttcttacatgctgtggggggtcgcttattcttttgtcaatattccgtacggctccctcggcgcagccattacacaggatgcggaggacagaacggcgctttccgcattccgccagataggctctctcggcgcgctgctcattacaagtgtcatcgtcatcccgattctcgttcattttgataacgttcacatcggctacccggcagtcatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatacaacattaaatccgctatgcttgtttacttcgcccaatacaatctcaacaatgcggagctgatgtcctacatgagttttatcatcatcggctcttcatttttaggtgtgttgtttatgccgaaactcgtcaaacgcttcggaaaaaagcaaacggtgatgatcggttttgccgtcagcgccgcggctgatgcgctgaatttctgtctcccgtcaaatgtatatatctttacggcgttagcgagcattgcttttatcgggatcagtataccaaacggcattacgtgggcgcttgtgtcggacattattgattacggagagtggaagacgggtgaacggaaggaggcgacgacatattcgcttttcaacttctccagaaaactcgcccaatctttatcaggttttctttcaggcatcgggctgagcgttatcggctatatcccgaatgcgtctcagacaaaaggcacgttaatcgggattaaagggcttctgctgctgtacccggctttcgctttagcgtgcgctatgctgattatcggtttaatgtataaactgacggaccggcagcatgccgagctcgttcaggacttacatcatgcaaaacctcaactttagtgattttatggactgtccgttaatgatacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacagaaaatattagagctcgcttcacagctgaattacacaccgaatgtaaatgcaaaaagccttgccatgcaaaagtcccatacgatcggactgttttttacaagcatcacaaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggatattgatgatcggagcatcacgaatatcctgtcaaacgataaagaaggctccagacaggcggtcgactgcctgatcgcaaacggacacagagatatcgcgatcattgagggaaaggaaggattcaggtcagcttctcagcggaaagaaggctatttgacatctttaattgatcattctattccgattaggcatgaatacagtgtaaaaggccgctatgatatggagagcggcagtcaggcgatggaaaaactcttggcgcttcaatcaccgcctacggctgttttttgttcaaacgatgatatggcgatcggggcgatgaataccattttcgccaaaggcctgaacgttccggaagatatatccgttatcgggtttgatgacatcggcatttcccaatacatgacgccgaggctttcgacagtaaaacgcccggttgaaaaaatcagcatactcggcgcagagaagattttggcgcttatcaccgacccggatacggcggcggaaaaaatatacgaaaacaccgaggtgatgataagagattcaattaaaaaactcacataacggcccgtctgattatccgggttttcgtacggaaaaatgttaacgtgtgcataaatataaggaggcggacagcttgcggcagctgaataaaaagatgtgcggtgaatacattcaatatcctgaaaaagtccttcagttcggcgaaggcaactttttgcgggccttcgctgactggcagatcgatcaattgaatcaattgacggattttaacggaagcgttgtcgccgtacagccgagaggctctgagaaaatcaaacgtttaaacgaacaggacggtttgtttacgctttttttgcgggggttaaaggatggaaaaccggctgaagaacacacgatcgtcaaatccatcagccgcggcattgatctattttctgactatgattcctttaaacagctggcagcacaagaggatcttcgttttatcatttccaatacgacagaagcgggaatcacgtttgagaaaggcgaccggcttgaggatagacctcaaaaaacattccccgggaaattagcggcgttcctttattttcgctataaggcatttgcgggtgccgccgagaaagggtgcattgtgcttccatgtgaactggtcgaagaaaacggacggaaactgaaggctgccgtgcttcaatatgccgggctgtggaagctggagcctgattttactcaatggattcatgatgcgaacatcttctgcaataccctcgtggatcggattgttccgggatttcctgttgatgccgcggaagaacttaccgattttctcggatacgaagaccgtctgcttgtggtcggagagcattattatttgtgggtgatagaagggccggaacagctacagaatgagcttccttttgctgatgccgggctaaacgcactgatcacgtctgatcttacgccttacaggacaaaaaaggtgagaatcttaaacggcgctcatacggcattggcgccagtggctttattatacggactccaaaccgtccgggaagcggctgagcacgaggtgacgggcagattcatcgaagaactgatcaatgaagaaatccttcccgtgctgcaaatggagggtgtcacccagtatgcggcagatgtgttacaccggtttaaaaacccttatatccaacattatctgcaaagcatcacccttaacgccgccgcgaaattcaaaacaagaaacctgccgacgctgaaggcttatatcgaacaggagggccggcttcctgagaggctggtattttcattcagcgccatgatctattcatactggaacgggctgaacaaaccggcagatggcgaggaggttctgaaccgttttcaaatggcgcggtcccgttgcaaagatgatatgtttcaagcggcattttctatattaggagaagagcgattgtggggaaagaatctgaaccatcttccggggctgactgaacgaacggctttttttctctctgtcattcataagcgggggatgaagcatgcgttacatgaatgctgcggcaataaggggggaagtgaaatgaaagaggtcataaaaatccataaaaacgataacgtgcttctcgctatgcgccattttaacaaaggggagcggctgcatacagacggactgacgattgaagtgaaggaccttgtaaagcgggggcataaaatcgcgctgcaaaccattgaagaaaacggcagcatcattaaatacggtttttcgatcgggcgtgcgacaaggcggatttcggccggcgagcatattcatacccataatctgcaaacgaatttatccgatgtgcaagaatacacgtattcaccgcgcttcgaggacaatccttttacaaatgagaaccggacatttcaaggctacaaaagagaaaatggtacatccggcgttcggaatgaactgtggatcgtgcctacagtcggctgcgtaaacggcgtcgctgagaaaatcctgcagcgcttcgtaaaagaggcgaaagacattgccccctttgacaatgtgctggttttaaagcaccaatacggctgctcccagcttggcgatgatcatgagaatacgaaacaaatgctgattaacgccattcgtcatccaaacgcgggcggtgtgctggttttagggctgggctgtgaaaataatgagctggcggcaattaaggaaacgctttctgaagtgaacggagatcggttgaaatttctcgaatcacaggctgtcacagatgaaattgaagcggggacagcgcttcttaaagagatacaccttgcggcaaagggagataaacgtgaggagattccgctgtcagaattgagcatcggattgaaatgcggcgggtcggacggtttttccggcatcaccgcaaaccctttattagggagattttcagattacttgattgcacagggagggagcacggtcttaacggaggtgcctgagatgttcggcgctgagacgattctcatgcagcgtgcggcgagcgaagaagtgtttcataaaacagtccgattgatcaatgatttcaagcaatattttatgaagcacgagcagccaatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaagggattgacactgctcagtgcgcccggcaatgatttaatcgcttcttcagcgctcgctgcggctggctgtcacgtcgtgttatttacaaccggaagaggcacgccgttcggcacatttgtcccgactgtgaaagtatcaacaaataccgatttatttcaatcaaaacctcattggattgattacaatgcgggcagattggcggaagaccaaacaacagaagatcacattgtgagagattttattcaatacattattaaagttgcaagcggagaatacgtcaataacgaaaaaaacgattttcgggagcttgcaatctttaagtccggtgtgacgttataagggaaaaggcgatctgacaacagaccgccttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcaaaaaggcatgtgcgatatccgttcccaccacttctgctgttttcattctgaacaggtataacatggcgatcgcaaataatgagccggacccaatagatgtcaggccgacgatgaagccgaaaatgacgccgatcagtatcatgagtgtccgcttttcttcaagtgttttttgctgccagcggttcggccgcagttttttatcgaaaaaaaggcgggcgataatggaaatggcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacgacaccgaacagtttggtgatggagttatataaaaggtcagtgccgacggcgattgaggggttgatccccaaaacgatcagtaaaggagtcaaaagcgccgctccccccacacccgtcaatccgaccagcgttccgacaaagaaacccataaacacaatgcttacagtcatctgtgtgcctcctgaataatcctactatttttatcagattatatatgattaagaggcagtaatcaattaaattttcggaaaattttatgcagaacaaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagttgctcttcagtcagctgtgacaggatgtctgtcgttttttcagtacatgcttcagccagtttgacgaggtctgtttccgcttcttctttcggtttgttctggatagctgacccgtttccgtcgttaatgacgtttgcaaacataagaaaagaataaacgatgtgttttacaagttcctgagcggacattgatgtctctgccggcttgtagtcgtaatgctcacggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatggagataaatcgttgcggatatccgaaattcgacaattgcggtctttttgcgttcttctttttctagcaattatgataaaatatgacatatctcggtcattccaaaaggggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcattctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcacacgtttgattttctggaagaacacatgctgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactgttgtcaggattgctgctagttgctgtcgggttcagctttacacaggtgatcggccatgaaagccatttggaaaaccaagcggacggcacgttccatattgccgcacgcaaccaaacataacataaagacccttctttggaagggtcttattttttgcatgcgtatccattccaattttatccgaatgcagggtcgatatgctcaagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggcaccggaaaccgaaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgtattttgtctgaaggccgctgggatgaagtgaaggcgaagattgaaaagaaattaagcggaagtatgccggcgaaaaaagcctctatttcttcttccgcgtctgaataccatgtgaaaaaaggcgacaccttatcggaaatcgccgcatcgcacggtgtcagcgtaaaatcactgcaaagcatcaaccatatcaccgatccgaatcacattacagtcggacaagtgatcaagctcgctcagacgggttcttcttcaaaaagtcaggctgtgtcttcctatccgcttccatccggtgtaatcaaagtgacgaaaccgctgacgaaagggacaaacgtaaaacaagtgcaaaacgctttatccgctctttatttttatcccgataaaggagcaaaaaatcatggggcggacggcgtttacggcccgaaaacggcatatgccgtaaaacgttttcaatccgtcagcggattaacggcagacggaatttacggcccgaaaacgaaggcgaaaattgaagaaaaactgtaatcaagaaaacggaagctccacgggcttccgtttcttcttacatacaaactgcggcaagggccttttgaatatcataaatgctttcatcttttttaaactgctttgagacagcgggaagttccgcgcctgaaatccaaattttcagctctgaatcaaggtcaaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcattgacattctcgccttccagcaaaatacgggccagttctgattttgcttcagccgtcgatattgtcgacgcattgcccagcaatccattgatgaaccccatgatatctcctccctgatacgtattctatcaaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcagaattgagccgggtgtcagtgagctggtgcaggcattttctgaccaaagctcaatttatttatttgaagggacgaagcggtgcgataaccgttctctccacttgacaagcacacgctttgacgagcctctggctttagaaaaagtgaccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcaggtgtaaatcccggcaacattgtcaatcggacaaaaaggaaaatggggctgcaattggaagtgagcacggcgcagagacacgcgctgttcagcaattttggctgccggggagaaaaatatacgccaaccgatctgttttttcggtatgtagaaaccgtgaaggccggtttttatgataaatgaacagggggcccgttcttacattcactggagctaggcggcgcatgaagtgcttggcgggcagcacggtgattacagcgtcatgatgcaaaaaccttttctccgatgtcaaaatgatgacattctgccggctgtgttcaaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcctgcgttttcttacctctgagactctttaatcttccgcctatcatccgaaatgacctctcttttttcaacaccctaagttacttatgattatagatacaaaatgtatcaaaagaaagggatgataaaaaaagtatcaaaaaggtcttgatgatacgaaatgtatcgtatataatcaacatcatagagatacaaaatgtatcaaaatacgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgagcgctatatacgtctgaagaaaaatggagacgtcccttatgaatcgtaaaagctacccgtttttcatctattccggattattgaattctgaacattatgacaaaatagggtccgccatttggctgtttttatggttcatcagctcaacgacaaaggaacatgtaaaagacggcataaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaaacactcgaaaagattcacgccgaaaaagacattaacccgcccggaagcaactgaccggacaatatcggcggatcaccgggacaaaaatgtccggagagaaatagatataacaaaaaatcatactgctgaagaagcgattaacgacattgccgcccattttatcagattaaggtctgcacaggaggggcggagcgtatacccgtcgccccgggattatcaggccatcgcccggattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcggggaggacaatcacaacaaaaaaagagaggaatacgatacatgacaaaacgaacgatcgagcagatactggccgacctgaaaaacggaaaacgtccattactggcggacagaccggaagaatcagacgaaagccgctttgactgcccgctctgtaaagatcagggcggttatctcaaaaaccagctgggaatggaagtgtgggtgaagtgccgctgcgccgccgaacgaaaagtagaacgcattctcggcgcaagtgagattacaaatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccggggtcggggaaaacccatcttttgaccgctctcagcaattatgtcatgagacagaagcagacaccggtgctgtattttccttttgttgagggctttacggatttaaaaaatgattttgatttgcttgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcctgtgacggattggtgcaggttgatgaagccctgggcacaagaatttatgagatgtgcagcgattatttagtcatcattaacggcaattcatttgacgtaaaccacagattagagggggcgagataatgtgtaagctgtgcggaccgaagaaggtcattgtgacggaaacgggtttcggcgctgtctttcacccttgcccgaactgcaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaaaacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctacggggagaaagttctgaagaaaaagaagcgttcataaatgagctcggaagcctcatacatgaagtgaacattttgaaaaagacggaggacgtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacgcgaaaaggggatctggcccgggtcgaatatgaaatcggctttaaattgaattaatcgaaaaaaacagaatacgtccaagacggaaagcctgcggacactgatcaatcgcgcacatgctgcgcattgattggtgtccttttttgttccgaaaaagaggaggatctacatggaagacttactatttgactataaacgcacgctgaaagagacgaaaaagtggtacaagcagctggaggaagccgatgaaacggtgcttacttcagaagaactgaaagataaaaaaatcatcagaacgattattacagatttggaatatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaacagacgatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacaatcggcagatggaaaaaagaagggcgctgggacgaggcgcttaaaaagaacgcggaaagcggcggaaaaaacaacccgggcgaaggtgatgagttaaacgaacgccagcggctgttttgtctttattatgtgaaatgctttaacgccacccaatctgcgataaaagccgggtattcaccggaaagcgcgcatgtgacgggaagcaggctgttaaaaaacgaaaaagtcgctagagaaatcagccgcatgaaaaaggaaatggtcaataaagtgtttgtcgaagcgatggacgttcttcaagtctatgtgaaaatcgctttcgctgacattaccgattatgtaaccttcggaaaaaaagaggttcaggccttcggaaaatcagggccgctctttgacgaaaatgataatccgattatgcaggagatcagctacgttgacgttaaagattcgcaccttctggacggaaccatcgtcacggaagcaaaactcgggaaagaaggcattgcaataaagcttgcggacaagatgaaggctcttgaaaagctgtccttgtactttgaccttttccctgaccaatttaaacaaaaaatcgaaaatgaaaaattaaagctggcacagcagaagatggaaaaaacagaagacagccaaaagccgattgacattgtcattacgcggaaagaggaacggccatgattgaaaaagcggttaacccgcgctttgaagattatttgttcaattggaatgaaacgtaccaatttctcgtcggaggctatgggtcgtcaaaaagctatcataccgcgctgaaaatcatcttgaagctgcttcgtgaaaagcggacggcgcttgtcgtgcgggaagttttcgatacgcacagagattctacttttgccttgtttgaggacattatcgaagagcttgagctgggacatgccgtaaaggccgtgtcatcaccgatgcagctgagattttcaaacggaagccggattatgtttaaagggatggacaatccggccaaattgaaatccattcatcatatttcactgatttggattgaagaatgctctgaagtgaaatatgaaggctttaaggagctgatcggccgtctgcgccatcctgagctttcgcttcatatgatatgcaccacaaatcccgtcggcacctccaattggacgtaccggcatttttttcgtgatgagcaaaacaaacggttcgtattggatgaccagacactgtatgaaaaaggcaccgtcgttaagggagatacgtattatcaccattccacagcgtgcgataatctgtttttgccgaaaagctatattaagcagctggacagcttacggcattacgatcctgatttgtaccggatcgcccgcaaaggacggttcggcgtcaacggcatccgcgtgtttccgcagtttcaggtcatggagcacaacgaagtaacggagcggattgcgtccatcaggcgccccctgtttcggaccggcatggatttcggttttgaagagtcatacaatgcggtcatccggctagccgtcgatccggatcaaaaagagctttatattttctgggagtattacaaaaacaaaatgaccgatgatcagacagctgaggagcttcaagaattggcggatcaaaaagagctgatcaaagcggattcggctgagccgaaaagcatccaatatttccgcaggcagggattttgcatggttgcggccaaaaagtttccgggctcaagacttcagtatacaaaaaagctgaaacggttcaaacatatctattgctcagacagctgtgaaaatacgatccgcgaattgcagaacttaacgtacgcaaaaaacaaaaatggcgttctgtcggaagatgagttttcaattgatccccacacactttcagccatttggtatgcgctggatgactatgacgcggcggatctgaaagatgcatcacaaaaacggagacgtccgaatcgggaaaggaggagataggcgttgcctaactatcaaaacgttagagccaccgtctttaaatcaaaaatggccgcgccgcaggcaaggcagatgaacgaagatcaatttgccgatctgtacggcgaagacatcatttcaccgccctataatctcattgaattgaaaacaatcgccgaatactcgacgattcttcagcagtgcattgacgcgtatcgggtcaatattacgggttttgggttcgatgtggaatatacctttgatgtaaatagcccagattgctcaccgtctaaaaaggcccgggccgaaaaaaactggatgaagctggagagcttttacaaatgtcttcattttgatgaatcggccgagacggtcctcggatatgcgatagaagaccgcgaaaaaacgggcaacggttttctcgaagtgcttcgggacggcgcgggaaaaccggcggggattgaatatctggatgtgaaacatatgcgcgtctgcggtgtgactgatcccgttgaagttacattttcatatgaagaaaacggcgcatccaaaacgattaaaaggcaaaaacggttccgtaaatatgttcagatgctgaacggacggaaagtgttttttaaggaatacggcgatccccgcatgatggacatgagaaccggtgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcacgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgtggaaattaaatcacttgcggaaattctgcaggatgatgcgctgtttcttgaatatgacgacaaaagcagaaataaactccgttccgctttccgtcttccgccgctttatacgggcgaggcgcaggaatacaacaaagccaccgccgatacggcacggaaaataacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataattttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcagtcaagcaatttctcgaccgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacacttgttgaggacatgctggcgccgattattaaacgcattgaagcgcttgaaaaagtaagaggcgcatcaaagcagccggaagaagagacgggcggccaagagcctgttaaaaaatcgatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagccttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagctagtcgtaaacggcgatacatcttcttctgatccgtacttggcacagcttgacggaatccgtaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggagccgcttcttatacaggacattctggaggcggaggcggaggcggccagaatggcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattctccggtttctgcacacgcaaaggtgagacctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggacaggcgtatattctggaaatgccgaagaaagcaagacagcaccattgggaggttatcgctgtgagagatgacagactatgaacataaaaaaccttgaacaatggaatcggtcgctgcaaaaggcatcatccggagaatttgcccgtcaggcaggcgaatggctggaacagtcaggagaggattttctcgacttggtacgggaggagcttattcattcgggcgggattgatacagaaagcctgctgtcttctttccggaaaggagcgcaggatcacgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctataatccgtcagcttcaacgggtatggcgctcaaaaaacagtggatcagcggaaatgggttttgggacaaagcccttcttttgtatgaaacactcttcgccgaatcgctggacaagcgtttcaatcagtggcttaacacgttggggggagatatccgatgaatcgcgaaaccggttcaatcgccgcttttttgtatcagcagtgcggcgtgcccgtatatgaaaatgaactgcctgaacaatttcaggtgccgtcactttacatcccgcccccgtatgcttttgacgagaatgacacagtctccacctttaagaagacatacagtctgaatgtgaagctgttccatgccgactcggtgcaggccctctatgcagccgacgggatcgccgatgcggtgagagaatcaagacagctgattccgctgcttacggaatcaggggaggataccggtgatttcgtccgcatcagccgtatcgaaacaagagtcggagacaaaggcgaggcagtgatcaccatccgctggacgagccgctactactatcaaaaacaaacatctcccgcactgcgggatgtggacattaacagcggggtgaaacaaaagtgaaacaatataaaaagaaaaacgccgcaacggcggaacgagcggttctttatgacacggcggatttaacaaagcacgcgaaggagcttttcggcgtaaaacccgagattctccagggtgctttattcggcgtgaagcaaaaacaaatgacaaaagcgcaagccaagtcttacattgaagcatttttaaccaaggaggtcatgcaataatgaacggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaggatttgaataaaaaagtggggctcagtattgaagatccatcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaacgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcatcgctcttcctgtcgcggaaaacgatcagctgaaagcgacatttgccgcattcattaaacgccttcgcgatgcgcagggacagaaagtgcaaggggtgaccgcccattacagcggggattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcctgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaagatcgtccgtgtgcttgatgcggtgaataacgatttgacacgtgaactgaaagccttaattaaatcgaaaaaaggcaccggaagcgatcttcctgcgacaaatgacggccttcaattcgtcaaaacgatgattattcaatatttgacaacgctccaggatgcgggcggcatcgctaactttgattcagacaaagacattacaatcgggctgaatgaagaccgcgacggctttttaatcgatctcgccgtacagcctgtggatgcggcagaaaaattctactttaatgtggaggtaaactaagatggcattaaaagcgcaaaacacgatttcaggaaaagaaggccgtttatttctcgacggagaagagatggcgcatattaaaacctttgaagcaaacgtggaaaaaaacaaatcagaagtaaacatcatgggccgccgcatgacgggacataaaacaacaggcgccaacggaacgggcacggcaacattctataaggtcacatccaaattcgccgtccttatgatggattacgtgaaaaaaggcagcgacccgtattttacgctgcaagccgttcttgacgacaaatcatcaggccgcggaacagaacgcgtcaccctgtatgatgtcaactttgattctgcaaaaatcgccggactggacgtagactcagaagccctcgaagaagaagtgccgtttacctttgaagatttcgatgtgccggaaaagctttctgaaacgttttaatcagaatcattgtgagtgaaacaggccttttacaggcctgtttttttataaaaaaaagagtaagggagttttcatcatgagcgaaaaaaacgaacaagtatatgatctgtcattctttatgccgggtaaaacagtcgaggctgaggagatccgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaatggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgcccgttttgaattggaagatcgggtttcaaagaaaataaggaaaatccaaaatggcttcagagcgcttgagaaatacaggaaaatgacaaaacgccaaagtgaaattgatatacgcaaagagagtaaatctgttttaagaacaattgaccgcatccagcgctctatgaaaagaaagctgggcgcacaaatgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaaaggtgacagcacagctggctgcaatgcaaaagaatatgccggacgtcggaaaagcttctgcatctgctgctcctgcttcgccgaaaaatgatttttcaatgcttgactccattgcagacaccttcatgaaaaaagtcaatgacatcgcatccaaattttatccggaaacaatcatagcggaactggataaattcgctgcaagctttatgaagaaagtggacgaaatcgcgagcaaattcagc

SEQ ID NO: 124 - DNA, 62669 bp, Bacillus velezensis FL50S
gtcttctgcttgaaaaaaaaatatgcctgccttgcgtaatcggtagatacatacgtttgtttcaaatagtagtagacttcagacatcttgaaaaagtactcggctttatcaatagtatccttaataaatgagagtttcgtctcagcctttttaaaaaattttatagccgacaaatattcccgctgatccagctcatacatcccccggaaaaaattaaaataataatcaagccgtccggtcagccgggcctgctttttatcaatatccgcgagcagatccgatagtctcggctgttcttctatccgctgcgattccagcggttcgaggtattcgagcatcagattgtggcggaattccatgagagaatagtacagatgaagatcctgatcttcttccaggcctgcaagctcttctttgatttctctccgcaagtactcggcgtccgggatgctgaaccttcgaatgtacatataccattcgttgattttttctccaaccgctgaagacgataaaacactcgccactattccgaatccctcccttccacgttatgtatatgacatattttatcattttcattcggaaggatagcgcaaaaataccgcaaacttttcccctttgacaaagccgtccgccgaaggaaccgcatttatcccgcagcctaggatttccggttttttcattttccttaaaaatcatgtttatcttcaaaaccactcagcaaagatggtaagataggaggaagcggttgaactttttcccttgaaaacttatactattcaggttaagcgggatgatgaaaaggaagtgtcagcatgagacaggagacaccagtagccattcatgtgcaatcattcattcataacggctccgaagaagagtcggttgaatttacatcgagtggattctattacgtgagaaacggcaaaacgtatctttcctatcacgaagagcatgatttgggcaagattaaaacggtcgtcaagatcacagaaaaagagattctcgtaatgagatcgggcgccatccaaatgaaacagcggttcattccgggggcatcgacactcactcaatataaactgccgttcggacaaatggagctccgtacggaaacgaaaaacattcaatctgatgtcggcggttcggaaggctccgtcaaactgacatataacatgactgtaggcgaaaaccaagaacatgtacataacatgacgatccaatataaggaggaaacaaaggcatgaatattgcggaacagatgaaggacgtgctgaaggaagagatcaaagcggccgttctgaaagcgggcctggcggaagaaagccagattccaagcgtactgttagaaacgccgaaagacaaaacacacggtgattattccacaaacatggcgatgcagctggcgagaatcgcaaaaaaagcgccgcgccaaatcgctgaggagatcgtggcgtcatttgataaaggcaaagcttccattgaaaagatggatattgcggggcccggctttatcaacttttacatgaacaacagctacttaacaaaactgattccgtccgtgcttgaagcgggtgaacattacggagagacaaacatcggacaaggcgaaaagattcaggtcgaattcgtatcggccaacccgacgggagatcttcacttaggccatgcgcgcggcgcggcggtaggtgacgcgctgtgcagcgtgctttctaaagcgggctatgatgtgagccgtgaatactatattaatgatgcgggcaaccagattaacaacctggcgctttccgttgaagtccgttattttgaagcgctcggcctcgagaaaccgatgccggaagacggttaccgcggcgaggatattatcgccatcgggaaaaagcttgccgaagatttcggcgatcgtttcgtacatgaagaggagagcgaacgtcaggcgtttttccgtgaatacggcttaaagtacgagcttgataaacttcgctccgacctggaaaacttccgcgtgccgtttgacgtatggtattctgaaacgtcactgtacgaaaacggaaaaattgatcaggcgctcgaggcgcttcgcgaaaagggccatgtatacgaagaggacggcgcgacatggttccgctccacaacgttcggcgacgataaagaccgtgtgctgatcaaaaaagacggctcatacacttatctgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacctgattgaagaagtcggcttggatgccgtgcgttatttcttcgcgatgcgcagcgctgatacgcatatggattttgacttggatcttgccgtatccacatctaatgaaaaccctgtgtattatgcgcaatacgcacatgcacgtatttgcagcatgcttcgccaaggggaggagcagggacttaaaccggcggcagatcttgatttcagccatattcaatcagaaaaagaatatgacctgctgaaaacaatcggcggcttccctgaagcagtggcagaagcggcggaaaaacgcattcctcaccgtgtcacaaactatatttatgatctggcttccgctctgcacagcttctacaatgcggagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttctttttttgcatgtaaagcgtgtgatgtaattcacaatccagcacactgagtttttgtatgataagactgatattgaatcagtgaaaggggcaagccgaatgatcaatcgtcaacatattcaattatcgctgcagtctttaagcttagtggcagggtttatggtgtgggtgctgatttcatcgctcatttctcaaatgacatcagatattcatttaagcaaaggcgagatttcattggtgacggcgattcccgttattctcggatcgcttctccgtattcctttaggatatttaacgaacaggtatggcgcgcggctgatgtttatgatcagcttcatcctgcttttgtttcccgtattttggatcagtatcgcggattctttatttgatttaatcacgggcggctttttcttagggatcggcggagcggtattctccatcggggtgacgtccctcccgaaatattatccaaaagaaaagcacggtgtcgtcaatgggatttacggtgccggaaacatcgggaccgccgttactacctttgcggcgccggttatcgctcaagccgcgggatggaaagcaaccgtgcagatgtatcttgttttgctggctgttttcgcattactgcacgttttgttcggcgaccggcatgagaagaaagtcaaagtttccataaagacacaaatgaaagccgtttaccgaaatcatgtgctgtggatgttgagcctgttttattttattacgttcggcgcctttgtcgcctttaccatctatcttccgaattttttggttgagcattttgggctgagccctgcggacgccggtctgcggacggccggctttattgcggtctctacgctgctcaggcctgtgggagggtttcttgcagataaactgagcccgctccgcattctgatgttcgttttcgcagggcttacgctgtcaggcgtcatgctgtcattctccccggcgatcggcctttatgcgttcggatcgctgacggtggcagtctgctcagggattggaaacgggacggtatttaaactggtgcctttctatttttcgaagcaagcggggattgccaacggtattgtgtctgccatgggcggactgggcggttttttccctccgctgattctggcaagtgtatttcaggcaacgggtcaatacgcgatcgggtttatggcgctttcagaggttgcgttagccagctttgtccttgtgatctggatgtattggcaggaaagaatgaaaacacatacggagagaaacagtcatagccttgattcataatgatccattcacaagattgttagttttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacacacgtatttgtttcaagaaggaatggatgcagaagagctttatctgattcaatcaggactcattgaaatcggcaagctgacatctgacggaaaagacctgacacttagaatctgccaaaaacacgatattgtcggagaattgacgctattcacagatgagccgagatatatgctcagtgcgaaagtgttagaggacggggaggtgctcgtcattaataaaaacaggctggaaaaggaattgatccaaaacggtgttttgacgtttgaatttatgaaatggatgagcacccatctgcgaaaaatccagtctaagatcagggatctgcttcttcacggcaaaaagggggcgctctattccacccttatccgcttatcaaacagctacggggtggaacgaagcgacgggattctgattaacattgtgctgacaaatcaggatttggctaagttttgcgcggcggcaagggagagcgtcaaccgcatgctgggcgacctccgcaaacaaggggttatttcgatagacgaaaccggaaaaattattttgcacaagcgggactatttacgatgcgagatcgagtgtgaaaattgtccgcttgagatctgcaatattgactgaaaaaaacaagggcagccgatgtccttgtttttcagcttgtgatacatatacacatgacggcgaaaaagaagccggcatttacgatttccagaatgccgatcgttttcaccagccagtctcttccgtgaaaaaaccaggcccgcagactgcttgggataaaagcgagaaacgcccagcctgccccgagaagagccgataaaaaggggagcaagaggtgatatccccacgaccagtaagcaaaccttctgttttttctctcccgtatgaccgatttcacataaaaagaactcccgacaaaaaataaagcggattgcaagaatagaaaccaagcccagccgtcaaggattcccgttcccagccagcagctcgcaagcccgcctgaacaaaagaacaagactcccgcaatatcattcgtgagcgcccgttcgttttttcggcgggcataatgcgtatgtatgagaaacagcggcaataaaaaaacgccgatccagacgagctgcggcttatgaaagacagaaatgatcaaaaagcagcaggccggaaaaccgtaataccatatccacttttgataaggctgaagctgtttctttttcaaagcgagcgaaacgggataaaccgtcaagtaaaggaacagccagcccagaaagagcggaatatgccagaaaaccgggcctcccttgaccatgccgagtaaaaatggaatcagcagcatcgcccatgcgccgtgctgcttcggaatcatcgctttcatcgaaaccctcctttttatttcattataagtgcaaacactctcctgataagtgactttcatcatacaagctgtgaaatacatcactgccgcgcgggctcaatcgggctacactaaagctatcaatagcacaggaggctttcctatgaatcagtgtgactatttattatttctgaaacaacttcctatgtttaatgaagtgcctctgtccattgtcgaaaccttgctgaaaaacgggacgtttatccgcggctcatctgaccaatctccatcctttcttcattcacaatccgtttatattgtattaaaaggcaatatccgttttacggacagcaggctccctgaagggtcgcaaaccgttgcgctgtgggaaaaaggcgatgtgtttccgattgatgaaaaaggcgggctctctttatcgccttttatctcagtcaatgcctcaccggatattctggtactccatattccgtattctatatttaagcaaatgatgtcttaccatccgcggctgcaaatgaactttttggcgatgcttcagcaaaatgtcttctgttcctatcagttgtttttgcggtatctgcatacatcactggatgaaaacgccgaacccggttcttaaacagaaccggtttttttgatgacgcgggcgtcctcatatcgtttgaaaatccttcctgctgatctgtgtgaacgttttgtgaaaaaagcagagtgtgtgacttagttcacaaggtgatgcgccgtctctgtttatagtgtacatagcatcacctgactcggaaggagtgaacgatcatgaagaaaaagaaaatgagtccgttgctcaggagattaaactatttttctcctatcgaacatcattcaaataaacatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggaccggatatgcctgatttcgaaccgagaggctgtccgcgaggggccagtttttcttggtacatctacagcccgctccgtgtgaaatatccatacgtgcgcggtgtgctgatcaatttgtggcgggaagcattgcaggcgcatcaaaatccgctggatgcctggaaatcgatcgttgaaaaccctgaaaaagcgaagtcctataaacaggcaagagggaaaggcggctttgtccgcgcggaatggccggaagtgctgaagctgatttcagcctctctgctgtatacagtcatgaaatacgggcctgaccggaatgtcggcttttctccgattccagctatgtccatgatcagccacgcgtcaggttcgcgattcatgtctttaatcggcggcccaatgctcagtttttatgactggtatgcggatctcccgccggcgtccccgcaaatttggggcgaccagacggacgttccggaaagcagtgattggtacaattcaggctatatcatcacatggggctccaacgttccgctaacgagaacgcctgatgcgcattttttggcggaggcccgctataaaggcgccaaggtgatttcaatcagtcccgattttgcggagtcctcaaagtttgcggatgactggctcagtatccgccaagggactgacggagccctggcgatggcgatgggtcacgtcattctgcaggaattttacgtgaatcaagagacggaacgtttcatggaatacgcgaagcaatacacggattttccattcctcgtcaccttatcaaaagaaaatggcgtatacacagcgggacggtttctgcatgcgaaggatatcggacggcagacaaagcatgatcaatggaagccggcggtctggaatgaacagacaggtgcgtttgccataccgcaaggaacaatgggctcccgctgggacgggcagcagaaatggaatctgcacatgatcgatgaagacaccggggaacagatcgagccccgtctctccgtgctcggaatagaggacgaaatcagtacggtgcgcattccgtatttttcaaatgacggaaacaaagtgcttgagcggaatcttcctattaaaaaactggaactgaacggtgaagaggtgtgtgtcacgactgtatttgacttgatattggccaactacggcgtgaaccggggcatcggcggacaatcagccgcatcttatgatgatccccgtccgttcacacctgcctggcaggaacagatcacgggaattaaaagagaagccgttatacagattgccagggagtttgcccaaaatgcgattgatacagacggcagatcgatgattatcgtaggggcgggaatcaaccactggttcaactccgacacgatttaccgcgcggtgttaaatcttgttttattggtaggcgcccaaggcgtaaacggcggaggctgggctcattatgtcggtcaggaaaagctccgtcctgctgaagggtggcagacgatcgcaaccgcaaaggactgggaaggcgtgcctaaactgcaaaacggcacctcatttttctactttgcgacagaccagtggcgttacgaagaccagccgatcagtgacttggcttcaccgatcgcttcttcatcccgctacaagcatcacgccgattacaatgtgctggcggcgcgattagggtggctgccgtcctacccgacattcaatcaaaacggcattgatctgtacaaagaagctgagaaggcgggggcggcgacacctgaagacgtaggtgcgtacgtggcctcacagcttcaggagaaaaaactgaaattcgcgattgaagacccggacaatgaagtgaatttcccaaggaatctctttgtatggcgggcaaatctgatctcaagctcaggaaaagggcatgaatattttcttaagcatctgctggggacgacgaacggtttgatgaatgacgacagcgacagcatccgccctgaagaaatcaaatggcgggagcaggcgccggaaggcaagctcgacttgttaatcaatctcgactttcgaatggccggtacggcgctgtattccgatatcgtgctgccggcagcgacatggtatgaaaaacacgatctcagcagcacggatatgcacccgttcattcatccattcgctccggcgatctcggcgccgtgggaatcgaggtcagactgggatattttcaaagcactgtcaaaagccgtttccgacctggcggaagaagtcgatatggagctggtgaaagaggtagtcgcgacgccgctcctccacgacacgatgcaggaattggcccagccgttcggaaaaatcaatgactggagcaagggcgaatgtgaagccattccgggaaaaacgatgccgaatatccaagtcgctgaacgggattacaaacacatttttcataaaatgaccgcgctcggccctcatacggctttaaaaccgagcggaacaaaagggatgagctggtcgattgcggatgaatatgaatcactcaaaaagagactgggagaaaccgattcagacggcgttgccaaaggatgcccgaatataagtgaagcaaagcaggcggcagaagcgattttaaccctgtcgtccacctcaaatggaaaggtcgccgtaaaagcatgggaatcgcttgaaaacatcacaaacctgaagctgaaagacctggcggaagaacgcgaggaagaatgctttacgttcgagcaaattacagcccagccgaaaacggtcatcacgtctccggcctttaccggctcagaaaaaggagggcgcaggtactcgccgtttacgacgaatgtggaaaaattaatcccgtggaggacactgaccggcagacaatcctattatgtcgatcatgaactgatgatggaattcggtgaaacgatggcgacatttaaaccgatcctccagcaccgtccgttcctgagcaagcggcctgatcaagagggcaaagagatcgttcttaattatttgacgccgcataataaatggtccgtccacagcatgtattttgattccctgccgatgctgacgctgttccggggcgggccgaccgtgtggatgaataaagatgacgcaaaggacacggatatcaaagacaacgattggattgaatgcttcaaccgaaacggcgttgtcgtggcgagagcggttttgtctcaccggattcctaaaggaatggcgtttatgcaccatgcccaggaccgccacatcaacgtgcccggcacaaaactgacgaataaccgcggaggcacccataacagcccgacaaggattcacgtcaagccgacccagatgatcgggggctacgcacagctcagctacggctttaactattacggtccgacggggaatcagcgcgatctgaatgtcgtcatccgcaagctgaaggaggtcgattggcttgaagattaaagcgcagatcggaatggtcatgaacttggataaatgcatcggctgccacacgtgcagcgtcacctgtaaaaacacgtggacaaaccgttccggtgcggaatatatgtacttcaataatgttgaaacaaagcccggtatcggctacccgaagcaatgggaggaccaggacaaatataaaggcggctggacgttgaaaaaaggaaagcttgaactgaaatcaggcccgaaaacaaaccggcttgcaggccttttctataacccgaaccagccgacgattgatgattactatgaaccttggaactatgattatgaaacattaacaaacagcccgcagaaaaagcaccagccggtggcgcggccgaaatcgtccttgacgggcgattttatgaatatcgaatggggcccgaactgggaggatgatctcgctggcggccacattacgggtcttgaagatccaaacgtgcaaaagatggaggaatcgatcaaaacagaattcgatgaagtctttatgatgtatctgccgcgtatttgtgagcactgcatcaatccggcgtgcgtgtcctcctgcccgtccggcgccatgtacaaacgcgaggaagacggcatcgttctcgttgatcaaaacgcatgccgttcatggagatattgcgtctcatcctgtccttataaaaaagtctattttaactggcaaacgaacaaagcggaaaaatgcacactctgctttccgcgcttggaggcggggctgccgaccatctgctccgaaacgtgtgtgggcagaatccgctatctcggcgtcatgctgtacgacgcggacaaagtggaggaagcggcatctgttgaagatgaaaaggatctctaccattctcaactggacgtttttcttgatccgaatgatcctaagattgccaaactggcaaaagaacaaggtatcccggctgaatggatagaggccgcgcagcaatcgccgatctacaaaatgatcatcgattggaagattgcgctgccgcttcatcctgagtaccgtacgctgccgatggtttggtacattccgccgctgagcccgattatgaatctctttgaaggaaaaggcagccggcaaacggcggaagatatttttccggctatcgaccaaatgagaattccgattgactatttggcccagttattaacggccggtgatacggatcatattcggtcaacgttaaagaaaatgtctgtcatgcgccagtatatgagagcagtccagacgaataaatccatcgacccggcactgatctccggtgtcggcttaacagaaaagcaaattgaagacatgtatcggctgctggcgatcgccaaatatgatgaccgctttgtgatcccaagcagccatcgagaagaagtgtctgatttatacgctgaacaaggaagctgcggcttgtcattttcaggcggccccggctcttgtttctaacttttgataaatgaggtgaaacaagatgaacaccacagaccggcaaatgacgttcgcagctctttccattcttctctcttatccggatgaagagtggagagccgggcttcccgattggaaggctcttatccatgacgtcaccaatcagcaaatccgtgagagactgctgcactttttagaggcggcagccggcttttctccgcaagcgttgattgaacactatgtgtatacgttcgacttcgggaaaaaaacgaatatgtacgtcacgtactttaactcaggcgagcaaagggagcgcggcatcgaattgctgcatttaaaagacacctaccagcaatccggtttcctgccgacagagaaagaattgcctgattacctgccgctgatgctggaattcgccgcggttgcggagattgaagcggcgagaagcgtgtttgagaaatacctgtccaatgtgcgggagctggcttcccgcctcgaaaaaaatgacagcctctatgctgagctgctgcacgtgctgcaggccgcgctggaaagcatcggtgtacgtgaaagcactgaagaaggggctgttcaggcatgagcgggcagatcctgtgggggattatgccgtacatggtattgacgatctttatcggcgggcatatttaccgctatcagcatgaccagtttggctggacggcgaaatcaagcgagctgttagaaaagaaaaaacttgcggcgggcagcacactttttcactggggactgctgttcgttgtcggcggacatgtcatgggaattctgatcccggaaggcgtgtatactgcacttggcatttcagagcatacgtatcacaaaatggcgatcggcgcaggcctgccggcggggatcgcggcttgtgccggactagtgatcctgacatacagaaggctgtttgacaaaagaatccgcaaaaccagctcgccatcggatatcctgacgcttattctgctgctgttcatgatgctgtcgggcgttgcggccacgtttctcaacattgactcgaaaggatttgattacagggcaacagtcgggccgtggttcagggaaattgttttgttccggcctgacgcttctttgatggagagtgtcccgctatggtttaagtttcatatcatcatagggtacgtcgtttttatcctctggccgtttacaagattggttcacgtgttcagcctgcccctcaagtatttgacccgcagctatgttgtctatcggaaacgcacgtaaaaatcccctgcaagagggggatttttttatggtgaaaaaataaaaacataagatattttctgccaaggtaatggctgggcggcggggattcctgttatgttttatgtggaaataatatcaacaaaaggagagtgaagaatgaagcggattttcctcattttagccgcctgtctgatgacaagcgccggcgtcctgacactcagacattctcatgtattaaccggcggcacagcgggactgtcactaagcctgtcgtacttgtttcattcctcgtttgcgattatcttctttctgatcaatatcccgttttatatattttctctcatcagaatgggaatcaaattcactctatccaccgtttttgcagtcactgtgctgactctgtttaccggcgcggatcactggctgccgccggtctctgtttcaccgcttgccggggcgatttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcggattgctgaaagggctcttctccttagtgtcgatagcggtcaccggtctgatcatcggcatcttcaaaaataaaatcaaaggcagctgctcgctcaatccggcattgcttcagaacatcacaaccggccagtcacaggaagtgtcatcataatcctttccgctcgtgcggagaggatttttcatatgtttacaggctggaaaacagagggtatacagagatatcggatcagatgggagagagtcgggatgctgaaaaggagactggaattttgctttttatatatgatgcttatcggagcatatgtcatatggttttttccggtttccaggcttgagttttacggagggttgctttgctacgcaagcattattttgttcagcatctattcgttaattcttgaaaaccgcacctcgcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacagacgcccgatctgtccgggctgaaaggaaatcagaagcgtttctttcaatattcaatcaaggcgtcccatatgaatatcaatacaaaaagcaggctgaaggtgctcaaaaacggggatgaaacatttccggagctgtttgaagcgatcaggtcggcagcatcatttatacatattgagtattacatgttcaaatcagacatgcttgggcacaagatgatggacattatgatggaaaaagcgcgtcaaggcgtggaagtgcggtttttgttcgacgcggccggcagcctgaagctggccggaaaagacattaaaaaactgaaacgcgcgggcgtgaacatcgtcccgtttctgccgctgaaatacggttttttcaaccaaaagttcaatttcagaaatcaccgcaagatcgtcatcgttgacgggaaaaccggttttgtcggcgggctgaatgtcggcaaggagtatatcggcaaagaccaaaatgtcggcttttggcgggacacccatatgaaagtcgaaggagaaatcgttcagacgctccacagcatttttatgcttgattgggaatacgtttcggatgaggtgctgattgatcagaaagcatacagccgcccggtccctgcagaaagcggcggcgtctatcaagtcgttccgacgggacccgatatgaaggagcggatgagcgatctgtattatgccatgatagcggcggccgaatcatctgtatggatcgcgacgccttatttcgtgccgaatgagccgatccgcacagcgctaaaggaggctgctgccagaggcgtccgggtgcgagtcatggtgccggaaaccaatgacggatttttaacccagtacgcgacgagatcgtatttccccgagcttcttcgcgaaggaatcgaagtctattcctatcaaaaaggctttatgcatcaaaaggtgctcatcactgacggaaacctcgcctctgtcgggacggcgaacatggacatgagaagctttcagctgaactttgaggtcaatgtcttttttacagatcaaaaggcgatcaaagatcttgaagcgcattatctggaggatatgagagagtctgagaaaatcagccccgtccgtttctataagcgcacattatgggaaagaacgaaggaatccttcgcgcggttattttccggcgttttataaaaaacgcttttaaaactccttgtgtatagtataattgagaaatattatcattaggaacgaggcacaaggaggacggaaacgtgctgcgacaatttttttcttattataaaccgtacaagaagctgttttttctcgacttcttttctgccatcgccggcggattgatggagctgagttttcctctgattgttaattactttatcgatacattgctcccggggcgggattggcgtctgattattttgacttccgctgctttattcggagtctacgccctcagctcggcgcttcagtatgttgtgacgtattggggccatatgctcggcattaacattgaaaccgatatgcgtaaaaagctttttgaccatctgcaaaagctttcgttcaaattttacgataacaacaaaacgggcagtttaatgtccaagctcaccaatgatttgatgtatatcggagaaaccgcccaccacgggcctgaagacctgtttatcgcggtcatgacgattttgggcgcgttcggtgtgatgctgttcattaactggcagctcgcgctgttgacctttatcattatgccggtcgtcatatggcttgctttgtattttaataaaaaaatgacctctgcgtttacaaaactgaacaaagacgtcggagacttcagcgcgagggtcgaaaacaatatcggcggcatccgtcttgttcaggctttcagcaatgaagcgtttgaaacgcagcggtttgacgtgaacaatcagcgtttccgcaaaacaaagctgaagtcatataaaatcatggcgaaaaacggctcgatcagttacatgctgacaagattcgtaacgctgttcgtcctgttgtgcgggacatggttcgtgatccgcggatcgttatcttacggggaattcgtcgcttttgtgctgctgacgaacgttctgttccgtccgattgataaaatcaatgcgattattgagctgtatccgagaggcatagccggttttaaaagctttatagaaataatggaaacggagcctgatatcaaggacgccccgaacgcgagacatgtgtccggtttaaaagggaatatccgttatgatggtgtgtcattcggttacgaagaaaacagcccggttctgtcgggaatcaatttgtccattcatgcaggggagacagtcgcattcgtcgggccttcgggagcggggaaatcaacgctgacaagtctgctgccgcgcttttatgagccgtctgaaggcgtgatttccatcgatggaattaatattaaggacatgacgctgtcatcattgcgcggacaaatcggcgtcgtccagcaggatgtctttctgttttccggcacattgcgggaaaacattgcgtacgggcggctcgatgcgtctgaggaagaaatccggcaggccgtccgccaggcgcatttagaggagctggtaaacgggtatcccgacggtttaaacacggtgatcggcgagcgcggcgtgaagctgtcaggcgggcagaagcagcggctttccatcgccagaatgtttttgaaaaacccgtcgatcttaattttagacgaggctacatcagccctcgatacagaaacggaagccgccattcaaaaatcgctgcaagagctgtctgaaggacgcacgacgcttgtgatcgcccatcggctggctacgattaaggatgcggacaggatcgtcgtcgtcacgaaagaaggcatcgctgaacaaggtcatcataaggaactgctggcatccggcggcatataccagagactccatcaggcccaattcggcgagctgatacataaataatggaaaaaggatagacgagcgggggccgggcagcctcctgtctatcctttttttatgtagtccgtatttaatgggcttctttttgcgcaggttcgatgatatgtttgaaacggtcaacaagctgcaccgctttctttccttccactacaattaaatattcttgttctttatgagccattctgaacgtttccagctcaatgatatctttgattttgcacattgtttttttagagtagatatacagctcgtggcctcccgtgtggcaaagctgataaagctgaagcatgtttcttaaagtgaacttcttagcggctattttcaaagatgtaatgtttttcatgtgttttctcctccgtctgatggtctgttatttcggaaattccccatatgaacgggtgataaacctggttatgccttccacctcagcactccgcccgccaggcgtttaactccgcggatggcgcttaattcttcgacgagccggagcagcgcccggtctttctctttcgcctcaatcataaaatcgatgtccgcatcccattgtctgaaccgctccagcaccggcagaataaaattcgcgtccacatagtccgcatgactgcgtacggctgattctgattttggcgaggagagatggaccttcggctttaagccgatccgctgccatgttttgatcatccgcggaagaatgtcatctaaatcagcgtcatcggccggattggcgtaaaaatggtgataatcaaacacaaacggaatgccttcttgctcacatacactgagtgtttcctcggacgtatatgttttatcatcgttttctaaagtcatccgctgtttgatgacatcgggaagttctttcagattcacgcggaaacgggcaagcgcgctttgtttgtcaccgtaagcgcctccgacatggatgtttatgacggaacggtccgcgatgcccattgcgtccagcatgtcataatgataggccatatccttgaccgcatttgcggtaatctcccgtttcgggcttgtaaaaagcgtgaattggttcggatgaaagctcgttctgaggtcatattttctgaccagcccgccgatctcacgaaactcctggcgaaacggcgtgacaaaatcccacagtacatccgggtgcgtggcgagcggcacaattgagcttgagaacctgtacaaagggatgccgtggccgaccacatagtggagggtgcgcagcgtattggtaagatttgctttcgtcacagaaagcagagcgtctttccgctcactgcgggaaagcttggtatagcgcgcatatgttaaggttttggcgggggacgcgtcccaaaggcacatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcctcatcatgaatgatgacatttacctcttcattccagaacaggctccgtttatcaaaattcggcgtgccgataatgctgatgcggtcatctataatgaaggctttaacatgataaaagccttgataataccgatagatgaggcagccggccttcaggagctcgggataataggtaaaagctgtttcccgaacgagcgggtgatctgatttcatcggaacgatcaagatgactttgacgccttttcggcaggctgaaataagcgcttcctgaagctttttgctcggtacataataaggcgtgccgatgatgatttttttctccgccttacggatgcagttttcataatgcgattcaagcgaaaaaccgtcagatgcatatgtcctatgagagatattcccttcggataatgccggataaaccccgggtgattcgggtgtttttccggtgtttcgtttcaggtcgcttacaaaaagagtctgaagatccgccgtgccttcgccggtcatccgcaggtgataatcctcccagtttccgaacttcgctttttttccgaggtactcttcagcgatattaaagccgccgacatagccgattttgccgtcaatgacggtcactttccggtgattccgtttttgcagcctgaaaaaaagaaagggaaatgccggtttatttagaaaatgaacgtgaacgccggcttttttcatcgtttgaatggaaggctttttcacttggcggctgcccgcccaatcgagcagcagatatacggagacgccggcccgggccttttctttcaataaatcaaacatctcatggctgacttggtcgttcttcataataaaaaacatcatatgaatagaagagacggcttggcggatatcagccgtcatctgctgcacaagctcgctgccgcagtgaatgagtgtgatatcactttttttggggtcaaaaacgggctcatacgcctgttttttgtacgccgcccggccaagcagcatatcaagcagcataagtgcgatcaatatgataaaaatgacaagcaacacaaaaatgaccttcataccgacgctcctttccgaagtatccgtagtgtgccctgagaatgtgaatttaattattgactgaacactcattcattatttatgataaagtaaagatatgacaatgaagaggggaatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacagaaaaaattgctgaaagataaaaagagcggaatcatccacgttctgtttttttacggttttatactcgttcagttcggcgcaattgattttattctgaaagggctgcttcctgaccggcatctgccgttcggcccgctttatccggcatttaccttttttcaggaaatcgtcacgtttctgattttaatcgccgtagtctgggcgttttaccggcgctacattgaaaagctcgtcagattgaaacgcgggtttaaagcggggcttgtcctgctgtttatcggcggactgatggtgacggtgctgctcgggaacgccatgaaccttttatggcacgatcattctctgtcttggacggaaccgatcgcttcctccattgcgtttgtgctcggcggtctttcagcgccggcggccgccgccgtattttatgtttcatggtggcttcatctgttgtttttgctcagctttttagtgtacgtgccgcaatcaaagcatgcgcacttaattgcgggtccggcgaatgtgttcctcagcaggctggattcaaaaggaaagctggaaaaaatcgattttaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacatcaaaatctccgtgggtgcccgcgcccgtttttcagcacacgaatgcgaatcagctcgccgcggcttcctctgggggaggatcgcgtgaagcggcggcagccattgattacaacccgagcttaatcggcgaggtcatcacggaagaggagatttgggcgtgcaccacttgccgcaactgtgaagatcaatgtccggtcatgaatgaacacgttgataaaattatcgatctgcgccgctatcttgtgcttacggaagggaagatggacagcgacgcgcagcgggccatgacaagcattgaaagacagggaaacccgtggggcttaaaccggaaagagcgggagaactggcgggagcaggctgatacagagattccgacagtgaaagaaatgaaaaaacaagacaaagagttcgactatttgttttgggtcggctcaatgggttcctacgacaacaggagccaaaagattgccgtctcatttgcaaagctgctcaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacggaatcaaaaaaatcgtcacaattgatccgcacgcctataatatgttcaaaaatgaataccctgatttcggattccgggccgaagtctatcatcatactgaattattagccgagcttgtgtcacaggggaaactaaaaccgcttcacccggtcaatgaaacgattaccttccatgactcgtgctatttaggaagatacaacgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgaggatcaacacggcccggactgagcaggcgctttctgtcagtccgacggtcatcagctccggatgtccttactgtctgaccatgctcggtgacgggacgaaagcgaaagaagccgaagacgcgatcggcacttatgatgtcagtgaattgctcgccatgtctgtattcggcgccgaaaaacaagagtctttatagaaagaagcgggccgccggcgcatatgccggcggctttgttttcgcacatcagccgatttatgaaggggcggctctaaaatttcttaaattacgctgtttagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttactcggtgttacgaaagaggaactgggcgaccgtatcgcccaattttatacagacctcaacattgacggccgctttattgctctgtcagatcagacatgggggctccgcagctggtatccgtacgatcagctggacgaagaaacacagccgactgtaaaagcgaaaaagaaaaaagcgaaaaaagccgttgaggaagatctcgaccttgatgaattcgaggaagttgatgaagatgacatcgatctcgatgaaatggaagaagatattgaccttgacgcagacagctttgacgacgaagatatcgatgaagaagatgacgacgagcttgagattgaagatgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggcagcatcacttggccgccttttgaaaaacagaggcatgagcgtcaccatccaaaaatttgacccttatatcaacgttgacccgggaacgatgagcccgtaccagcacggtgaggtattcgttaccgatgacggcgctgagactgaccttgacttagggcattatgagcggttcattgacattaatctgaacagattcagcaacgtgacgacaggtaaaatctattctgccgtattgaaaaaagagcgccgcggggactacctcggcggaacggttcaggtcattccgcacatcacaaatgaactgaaagaccgtgtgtaccgtgcaggcaaagaaacaaacgcagatgtagtcattactgagatcggcggaacagtgggagacatcgaatctcttccgttccttgaagccatccgtcaaatgaaaagcgacatcggccatgaaaacgtgatgtacattcactgtacgcttgttccgtacatcaaagcggcgggcgagctgaaaacaaaaccgacgcagcacagcgtaaaagagctgagaagcctcggtattcagcctaatatcatcgttgtgcgcacggaaatgccgatttctcaagatatgaaagataaaattgcgctcttctgcgatattgacacgaaagcggtcatcgagtgtgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagccttgtcggtaaatacgtcgagcttcaggacgcttacatttcagtcgttgaatcactgcgccacgcgggctatgcgtttgacgctgatgtgaagatcaaatggattaacgccgaagaagtgacagaaagcaatattcaagagctgactggcggcacagacggaatcatcgtgcccggcggtttcggggaccgcggcgtagaagggaaaatcatcgccgccaagtatgcgcgtgagaataaaattccgttcttcggcatctgcctcggtatgcagattgcatccattgaatatgcgcgaaacgtattaggtctggaaggggctcactctgcggagatcgatccgtccactccttatccgatcatcgaccttctgccagaacaaaaagatgtcgaggatcttggaggaacgcttcgtctcggactgtacccttgtaagcttcaggaagacacgaaagccttcgaagcgtatgcggatgaagtggtatacgaacgccaccgccaccgttatgaattcaacaacgaatacagacagcaaatggaagagaacggttttgtgttctcaggaacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagcggcaagtcttttttctgcatcaggcatattcctgcatcatttcctttaacgtaaaggacagcgcgtgatagacatacaggcctgtcattaatgaaggaaagccgtatcttgtcccgtcttcatcgggcagaagcggcatttttaatttgctgtcaatatgaacatcacaaaattcctcaatcccggtttgatctttgatgacaggagatacgcaaacgaggccgacccctttttcataaagcttttgagccagcgcctgttcttcagccgtgcccggacctgaacaaaacatcagcaccctgtcgctttctgtaatcgaatcagctgtatccggaaacgctttgacagaaggcatcggttctgagccgagttccgcctcgcacaaaatgccctgcatctcatttgcgccgtataaataaatggtatgaccgctgacggctgcctgcgccagcaggcgcgcgccgtcttctattgcatcggactccttatcctgaatgcgggaaaaaatgcctgcaagctgcgtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgttccataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgatcgacgaatccatccgcgtcattatcatgaccgcttacggagaactcgatatgattaaggaatcaaaagagctcggagcgctgactcattttgcgaaaccttttgacattgatgagatcagagacgcggtgaaaaaatatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctacataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgcgattcacttagaccacggttcaagctttgaatcttgtgcgaaagcgattcatgcaggtttcacttctgtaatgatcgacgcatctcaccatccgtttgaggaaaacgtagcaactacagctaaagtggttgagcttgctcatttccacggcgtttcagttgaagctgagcttggaactgtaggcggacaggaagatgacgtgatcgctgaaggcgtaatctatgctgaccctaaagagtgtcaagaacttgtagagcgcactggcatcgactgccttgcacctgcactgggttctgttcacggcccttacaaaggcgaaccgaacctcggtttcaaagaaatggaagatatcggcaaatcaaccggccttccgttagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagaaatgattgaagaaggtaaagaacttgcgaaaatcgcgccgaatattacggtgaaaatcccgatgacgtctgaagggttaaaagccgtaaaagcgctgagcgacctgaacattaaaacaaacgtaacgctcattttcagcgccaaccaggcgcttttggcggcaagagccggggcgacttatgtatctccgttcttaggccgtctggatgacatcggccataacggtcttgaactgatttcagaaataagacagatttttgacattcatgacattgatactcaaatcatcgcagcttccatccgtcatgcgcagcacgtgactgaagccgctttacgcggtgcgcatatcggtacgatgccgctgaaagtcattcaccagctgacgaaacatccgttaacggataaaggcatcgagcaattcttggctgactggaataaataagggggaaaagggcggcaaaccggttgcatccgtttgccgcacccttatgttttcctgtttggcagcgggccttcagtatcaaagtgaagagtgtgtttccccggaatatgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttacgctccgcagctatcttcttatggaaggagactatcatggaaaagttgaatattgccggcggcgatccgttaaacggaaccgtacatatcagcggtgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgttgacccttccccgatgatcagcatgccgcttcccaacggcaaagtgaaaaaactccgcgcttcctattacttaatgggcgcgatgctcggccgcttcaaacaggcggtcatcggactgccgggcggatgccatctcggtccgcggccgattgaccagcatatcaaagggtttgaggcgcttggagcggaagtcaccaatgaacaaggcgcgatttatctgcgcgccgaaaggctgagaggcgcacggatttatttagatgtcgtcagcgtcggagcgacgattaatatcatgcttgccgctgtactggctgaaggtaaaaccgtgatagaaaacgccgccaaggaacctgagattattgatgttgccacattgctcaccagcatgggcgcaaaaatcaaaggtgcggggaccaatgtaatcagaatcgacggcgtaaaagagctgcacggatgcaggcatacgatcattccggacagaattgaggcgggcacctttatgattgccggcgccgcgatggggaaagaagtcattattgataatgttataccgactcacctggagtctttaacggcgaagctcagggaaatgggtttttacattgagacgagtgacgatcagcttcttatgctcggcgggcagaagcagataaaaccggtcgacgtgaaaacgcttgtttacccgggattcccgactgatcttcagcagccgatgacatctctgttaacgagagccagcggcacgagcgtcgtaaccgacaccatctactcggcccgatttaaacatatagatgagctgagacggatgggggccaatatgaaagtggaaggcaggtcggccattatcaccggtcctgccgagcttcagggcgcaaaagtaaaggcgagcgatctgcgtgcaggcgcttgtctggtcgtcgccgggctcatggctgacggcgtaaccgaaattaccggtcttgagcatttagaccgaggctacagcaatcttgagaaaaaactcgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagctcggaaacggatacggcccgcgcgtcgatgtcgccgtcgatcctcttgaaggcacaaacatcgtagcgagcggcggctggaatgcgctgacggtgatcgcggtcgccgaccatggaacattgctgaacgccccggatatgtatatggaaaaaatcgcggtcggtcccgaagcggtaggctgcatcgatatcgaagcgcctgtcattgataacttaaaagccgttgcgaaagcgaaaaacaaagacattgaagatgtcgtggcaaccattttaaatcgtgacagacacgaaaaaatcatctctgaattgcgtgaggcgggcgccagaatcaaactgatcaacgacggtgatgtcgcgggcgccatcaatacggcctttgaccatacgggagtagacattctcttcggttcaggcggggctcctgaaggcgtgctgtctgccgttgcgttaaaagcgctcggcggcgaaatcatcggcaggcttctgccgcaaagtgcggaagagcaggcccgctgtgagcgaatgggccttgatgtatccaaagtgctccggatggaggaccttgtgagaggggatgacgccatttttgccgcaacgggcgtcacggacggagagctgctgaaaggcgttcagttcaaaggctccgtcggcacgactgaaagcctggtcatccgggcgaaatcaggaacggtccgattcgttgacggaagacacagcctgaagaaaaaaccaaatcttgtgatccggccataaatagagaaaagcgggacggaaagtcccgcttttcttttgcaaaaaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccatcctgaaagccaacgccgagcaggaggatcttctgtttatggaaggcgtgctcgaaatcatccaatcggaaggattcggcttcctcagaccgattaattactcgccaagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaagagcgcgttcattttcctgcgctgactccgctttatccggaccgccaaatggtgcttgagacgaaaccgaactatctctcaacaagaattctcgatatgatggctcccgtcggtttcggccagcgcggtctgatcgtggcgccgccgaaagccggtaaaaccatgctgttaaaagaaatcgctaacagcattacgacaaatcagcctgacgctgaattgatcgtgctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcggaattgacccggctgcgttccatcgtccgaagcgctttttcggtgccgcgagaaacattgaagagggcggcagcctgaccattttggcgacggcgctcgtagacacgggctcccggatggatgacgtcatctatgaagagtttaaaggaacgggcaacatggagcttcaccttgaccgttctcttgcggaaagacggattttcccggcgatcgatatccgccgctccggcacgcggaaggaagagctgctcgtgccgaaagagcatcttgaccgtctatgggcgatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattcgctccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacatatgcgaagcaggaggtcaaggtgttcaaacctgccattgataatcgctacagtgaggaggctgtcgtttctcacaacggcacatccatgacaagccacgtcatctcgtcttcggctgaaatatgggatcatatcagtgaaagcacggacgtcatcgcggtagatgaagtgcagtttttcggcgaatcaatcatcggcgatttatccttgcttgcggataaaggctatcgtgtcatcgcggccggacttgatatggatttccggggagagccgttcggtgtggtgccgaatctgatggcggttgccgaatcggtgacgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcaccacgaagtgccgaaaaaacagactgataaataacccttttcatgaaaacatcggtaaaaaatccggtgtttttttgacggtttttcaaaaattgtagttaattaacttaaaaaagagtatgaaaaaattaagtaattttcatctcttgaattttcatttttacaggcataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgaccattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaatgtagaaggaatcgaagaggcatttgaaaaccttcatgccactgccggagatattgatctgatcgttgcgacagactcagaaagcatcctcggaatcggtgactggggtgtaggcggtatcaacatcgccatcggtaaattagccgtatacacagctgctgccggtattgacccaagccgtgttattcctgtcgttcttgacgtcggtacgaacaacgaaaaacttctgaacgatcctttatacatcggtaaccgccatgaacgtatccaaggcgaacgttatgaagctttcattgacgcttatgtaaaagctgcgcttaaatatttccctaaagctcttcttcactgggaagaccttggaaacaaaaatgcgcgcaatatcatgaagaaatacaaccatgaaattcttacattcaacgatgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatctattcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgagaatgtagaacaagccgttcttgatgcaatgtggaaaccgcaatataaacaagttatcgctaaataatttttacgattaattttacagtccgagggaaagcttttatgtaaaggctaaagtatacggacattaaggatttggaggagaatattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgcaagtattttaaccacttcaagaagtgcgtttttatcacaggttcctttaatgatcgctttgatcattgggattgtcggattctttatcgtcattttgttggtttgcaaatttatcttcaagtatgatttaacgaattcatctgtattttctttaaactctgcacagccgacatttgcatttatgggtattccggtactcggaagcttattcggagcaaacgaagtagcgattcctatcgccgttacgggtatcgtggttaacgccatccttgacccgcttgcgatcattatcgctacagtcggtgagtcatctaagaaacaagacagcgaaaacgagaacttctggaaaatgactggtaagtctattcttcacggtctttccgaaccgcttgcggctgcaccgcttatcagtatcatcctggtactctgcggtgtaacactccctggcttgggtgaaaaaatgcttgatcagctcggaagcacaacatcaggtgttgcactctttgccgtcggtgtaactgtcggtatccgcaacatcaagctcagtctgccggctttcggtatcgctttgttaaaagttgccgttcagcctgcgctgatgtacttgatcgctcttgcagtcggacttccggctgaccagatcactaaagcggtattgctcgtcgcattccctggatctgcggtagcggcgatgattgccacacgtttcgaaaaacaagaggaagaaactgcgtccgcgttcgtgatcagtgcgattttatctcttatctcactgccgatcatcattgcgctgactgcataatgaaaagctccctgtttcagggagcttttttgattagaattgaaatttaaaaggcgaaaatctcgttttttttctgggtttcttatgttctgaagaagcggctgtttctgagaggggagctgtctgggcaagttcctggatgcgggaggccaatgtctgcaattcggtattgaggtcgtcaatttcccgtctgtgctgaagaagctgataagacaccccttcatccgccttttgtttcagctggcgttcaagctcctctatccttgaaagcagatggttctcatcctgtttctctttcgtgagaatgtccagtttacgctccagctctgccaacctttgttcagcgccgccattgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgcttgacccacctttgcaccgtttttgcggagacgccgagctctttcgcggccatgtttgtattcatgatcacatacctcctttttgctaggtattcgaccatgaggcggcgttcccttcatgttagacaaaacaagaaggaattcgccaaagaaagcggcatttcttcaaaaaacgttacgcttcatacaattcaagcggaagcttgtcgggatcgaagaaaaaggtaaaccgtttccccgtcagcggatcggttctgatcggttctgtgccgacgcccttttcctttaactccctgacggctgcttcaagatcgtttacggtgaaggcgagatgcctgagacccgcggcttccggtctggtcggccgttcgggcggatcgggaaaggaaaacaattcaatcgcatacgccccgtccagcgccagatcgagtttataagattcccgttcctttcggtatgtttcttttataatgccaaaaccgagtatctcggtgtaaaaagctttcgacttttcataatcagagcatatgattgctatatggtggatggatttcagcatatccgcccctccttttttgcttcagtataacagaggcgaattgcttttgactggtgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgacaaaaacgtaatcatggagatccgcggagcagcgggaggagaagaagccgcgctgtttgcgggaaatctctacagaatgtactcccgttacgctgaaatccaaggctggaagactgaagtcatggaagcaaacgtgaccggaacgggcggttacaaagaaatcatctttatgattacgggaaaaggcgcatactccaagctgaagtatgaaaatggcgcgcaccgcgtacagcgtgtgccggaaacggaatcaggcggccgtattcatacatccacggcgacggtggcgtgtcttcctgaagcggaagaagtagaagtggacatccacgaaaaagacatccgcgtcgatacattcgcatcaagcggaccgggcggacaaagcgtaaatacgacgatgtcggccgtacgcctgacgcatttaccgaccggtgtcgtcgtatcctgtcaggatgaaaaatctcagattaaaaataaagaaaaagcgatgaaggtgctccgcgccagaatctatgacaaattccagcaggaagctcaggctgaatatgatcagacccgtaaatcagccgtcggatcaggcgaccgttccgagcgtatccgcacatacaatttcccgcaaaaccgtgtgacggatcaccgtatcggcctgacgattcaaaagctggatcaaatcctggaaggcaagcttgatgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgctgttaaatgataccggaatggatcggagcaagcttctcgcaagtctgcaggagcccgtcggcgaggacgagctttaccgattcagacggcatgtggaaatgcataaagaaggcgttccgattcaatatattatcgggaaagaacagttttacggcagggaattctttgtgaatgacgatgttctcattccgcgtccggaaacggaagaagtcgtctttcatctgctggacagacagaagcgggtgttttctgagggagaacgcctgaacgtcattgatatcggtacggggagcggagccattgcggtgacgctcgcgcttgaatgcggacatttttcagtatcggcttcggacatttcaaaagaagcgcttcaggtggcggaaagaaatgcgcaaaaccttggagcggacgtccgctttttgcagggagatctgttaactccttttatttcatcaggaataaaagcggatattattgtttccaatccgccgtatatttctgaagaagaaatggcggatttgtcggatatcgtccgtttccatgagccgcttcatgctcttacggacggcggtgacggtttgaaattctacaagcggtttatggaggagctgcctcttgtcatgaaagataaagcgcttgtcgtctttgaaatcggatataatcagggaaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggctggatttgtcctgccgtttggctttgacatcattttcggcgccgttacggctgttcttatcgtcgcagcggtcatcgtttccgggctggccgtaagcggagcggagcagcgggccaattatcattctgaaacagaagaaggacggcgcgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaacgacacccccaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaaagcacggagaggaacggtggggaccgatgaaacagacaatgatgatctgcatatatatttttcttttattatcaggagcgcttgcgggtttgacaaaagaagaaacggcgcgggcatcagccgatgagcccgtcgtcataccggatgaagcgatccggctcagaattttggccaacagtgataacgatgaagatcaaaagctcaagcgccagatcagagatgctgtaaacaagcaaatcacagactgggtgaaagatatcacttccattgaagaagcgcggcggctcattcgttcgaagcttcctgaaattaaagaaatcgccaaacaaacgatgaaagaaaagggtgcgcatcaatccgtttcagttcaattcaataaaatctcgtttccgacaaagctgtacggcaatatggtctatccggccggaaaatatgaagccattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagacagaaaaagtgctggatgacgtaaaagcaaaggctgataaagcgaagaaagaaaataaagatgacgatgataccgaagtgaagtttttcctcgtcgattggatttcagatctattttcctgaagcaaaaggcataaatccggattcgattcatagattggaagaaagagttgatcgaaacggagggaaatatatgttttatcagctgagagtggcaagagatcaagatacggaggcgctggaggcctttttgaaaaagtctgatacggcacatgcgaaaatcgatcagcagatcagccggtttatcgtgctggaagacagcgaaaaaaagattgccgcctgtctcgggatcgaaaaattcagaggcggaaaagggcttctccgttcactcgtcatgtcggacaggctgaatcaaagccatatcgttacactgtttcaaagtatggatgtgctgtgcaaaaaacatgagattcaagatgtctacttagtcgccaatcagccctcatctgctgagtttctgaatgtgatgggatttgaagcgtgcgccgatgcgcctgatgaactgtatacgtccgaacatttccgcaactcgttatgcacagaaggttcgtttttaatggtgaaaacctctgcctgatctaacttatacacaaggttatccacttattaaaaagtgttgtccacagtttgtggataacgcttgttttattaaaggacatcttttatactttcaaaaggaatacacgagagaaaataaagttttaccgctttaaaataaggagtttggttatacatgaaaacaagaagatggtttgtggattgttccgcagaattatccacaaccgatccccaaattacacaagccgcggaattgctccggcagaatgaggttgtggcttttccgacagaaaccgtttacggactgggcgctaacgctgaaaatacggaagccgtaacgaaaatatatgaggcgaaaggaaggccgagcgataacccgctgattgtgcatatatcccatatcagccagcttgatcgttttatcagccatattcctgagacggcgaaaaagcttatggagctattctggccgggggcgctgacccttgtcctgccgtgtaagcccggtgtgctgtcaccccgtgtcaccgcgggacttgagacggtagcggtcagaatgcctgatcatccggcagcattagccctcatcagctcggccggactgccgatcgccgcgccgagcgccaatttatcaggaaaaccgagcccgacgaaggccgagcatgtagctcatgatttaaacggccgtattgccggtattgtggacggcggcgcgacgggaatcggagtggaatcaaccgttctgtcctgtacggggaaacagcccgtgctgcttcgtccgggcggcgtgacaaaagagcagattgaatccgccgccggtccggttcttgtggataaagggctgaccgaagaagatgaggttcctatttctcccggtatgaaatatacacattacgcgccttctgcgccgatggctattgccgacggcggcgcccggagaattcaagaactggcagacgcatataaaagccggggaaaacgaatcggcattttgacaacagaagagaacgccgatagttaccaggctgattatatcaaggtctgcggcagacgcgccgaccttgaaacagtggcgtccgccttatacgatgcgctccgcagctttgatgaagcggaagtggatatgattatttctgagtcctttccggataccggagtggggctcgccgttatgaacaggctgatgaaagccgcaggcggcaccgttatccattaacttgttctaccccttatcggacatgcataagctaaacaagcgggcacgtccaagggggtttttattcatgtcgaatctattcatcggggaacttgtctccttaagcatcatggcatttgctttggggacggatgccttttccgtcgggctcggaatgggaatgattcagctgaagaaaaaacagatttttcatataggggttgtcatcgggctgtttcatgtcatgatgccgcttgtgggaatggcggccgggcatctgctgtccggttttctggggatgctcgccgtttacatcggcggatctcttcttttcattttaggggtgcagatgatgatcgccgcgtttaaacagtcagacgggccgctcatatctccggcaggctcgggactgttgctgtttgcggtcggtgtcagtctggacagcttttctgtcgggctcagtctcgggatgaacggctccaatccgtttctggccgttacgctgttcggggtcttcagcaccgttttaacatgggcgggccttttggcgggaagaaaggtgcagtcatggctcggctcctacagcgaagcgcttggcggagccattttgatcggattcgggctgaaactgcttttaccgatataagatacgtaaaaaaagaaacgaagatgccgtttcttttttcttcatttataataggcagtaagaggtgacggacatgaaaataatctttgtttgtacaggcaatacgtgccgcagtcccatggctgaggctctttttaaatccatagcagaaacgaaagggctggatgtcagcgtaagctcggccggcgtattcgcgtctccgcacggaaaagcgtcggctcatgccgtagaagcgctgtttgaaaaacggatcgccctcaatcacagttcatctcccttatcggaagaacatatcgagacggccgatctggtgctggcgatgaccgaacagcataaacagctgattgaaggccgatatcaaaacagtcagggcaaagtctttaccattaaagaatacgtaacgggggaaaacggcgatatctctgaccctttcggcggtccgcttgatgtttataaacagacgcgggacgaactggaggagctgctaacccttttggctgatcaattgcttgacgggaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggacggcagtctgctggtgatcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaggctccccattgtttcagccgtccccgtcccgaaagcgggcggagcgatggcctcttatgcataccggcagatgcgttctccagtgctcgttgaatcgattcaggctgacgccgggattgacatcggtgatacgttcatcggcatgcatctgaaacccgttgccgtccctgtccggatatcgagccgtgagcttggagaagcacatgtgacgatggcccggacaagaccgaagctgataggcggaattcgcgccgtttatgaatgcgaatgataaaaatacttttcctctataatgttcgtgttttctaattaaattttgtgatttttttaaataagctgttacattcacctgaaaaaccatgtacaataaggtggtaaaaataaagaacaggaaacggataggagaggatctcgctgatgaaacatttacctgtacaagataaacaagtgtttaacgccatcaaagatgagcgtaagcgtcaacagactaagatcgaattaattgcttctgaaaacttcgtgacggaagcggtaatggaagcacaaggctctgttttaacaaacaaatatgctgaaggctaccccggcaaacgctactacggcggctgtgagcatgttgatgtcgttgaggacatcgcccgcgaccgggcgaaagagattttcggagctgagcatgtaaacgttcagccgcactcaggcgctcaggcgaacatggctgtttacttcacgattttagagcacggcgacacggtgctcgggatgaacctctcccacggcggccacttaacacacggaagcccggttaatttcagcggcgttcaatacaactttgtagaatacggtgtcgataaagacacgcaatatatagattatgaagatgtgcgtgaaaaagcgctggcgcataagccgaaactcatcgttgccggagcgagcgcatacccccgcacgatcgactttaaaaaattccgtgaaatcgctgatgaagtcggcgcttacttcatggtagacatggcgcatatcgcgggtcttgtcgcagccggccttcatccgaatccggttccttacgctgactttgtaacgacaacgactcacaaaacacttcgcggaccccgcggaggaatgatcctttgccgtgaagagttcggcaagaagattgataaatccattttcccgggaatccaaggcggaccgcttatgcatgtcatcgcggcaaaagccgtttctttcggagaagtgcttgaagatgatttcaaaacatatgcgcaaaacgtcatctcgaacgcgaagcgcctggctgagtctctgaacaaagagggcattcagctcgtatcaggcggaacggataaccaccttgtgcttgtcgacctccgttctctcggactgaccggaaaagtcgctgaacacgttcttgatgaaatcggcattacatctaataaaaacgcgatcccttacgatccggaaaaaccgttcgtcacaagcggaatccgtctcggtacggcggctgtgacaagccgcggctttgacggtgacgcgcttgaagaagtcggcgccatcatcggcctcgcgctgaaaaatcatgaagacgaagcaaaacttgaagaagcgaaacagcgcgtatctgccttgactgaaaagtttcctttatataaagaactggactattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagaccttgtggatgaagtcgcatcactgatggcgtttgaaattacacgtgatcttcctcttaaagaagtggaagtgaaaacacctgttcaaacagcgacatccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggctctgcggtggaagcgatcaacagcctgaaaaagcgcggcgcgagaaacattcgttttatgtgtcttgtagcggctccggaaggcgtggaagagctgcagaaacatcattctgacgttgatatttatatcgccgcccttgatgaaaaactgaatgaaaaaggctatatcgttccgggcctcggtgacgcgggtgacagactgtacggaaccaaataaatcggaaaacctcattcagggggttttctttttttttatccagattttagctgaatgggcagagttcatacatttataggtgaatttgtgaacattctgtgtatgcttccggtataaaaagttttttaactttaaacagattgacacatgttaggggctattgtatgctaaacgagggtattatgagaaggttttcattcctttcatttctagtatccatcctcattttaaatcctccaaaaaaacccgttatatgaggatttatctaagcgaatgaaacagcatcccgtagcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaaaatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattcttactacaagaacgctgtccatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctagggctgccgttttctgtaacggtcggacacgagctttggtggaaatcaccgacggccgatccggctattactctgactctagccgttatggttgtgtcgttaacgcactattacggcgtgaagatgaaaggtttgaaggaatactctaaggattacctcagaccggttccgcttatgttcccgatgaagatcattgaggagtttgcgaatacgctgacactcggacttcgtctttacggtaacattttcgccggggaaattcttcttggcctgcttgcgaatctggcgacgaatttctactcaaacagtttctttctcggtttggtcggcacagtcggagccattattccgatgcttgcatggcaggcattcagcttgttcatcggtaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggtgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccgaaacggctttttatcagcagagaaaacctgcagaagggagttgccgtagtagatgtctcaattacctcttgaattaggactgtcgtttaacggcggagatatcctattccaattgttagctatgttagttttattagcgcttctcaagaaattcgctctgggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaattactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccggaacgaagccggattacaggaagtgctaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggatgcggttgtttattcagtaaaaccgctgtcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtaagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtacacggccttgacaattgtatggccggtgaacttgttgagttttcaaacggcgttttgggtatggctcaaaaccttgaagaatccaacgtaggtatcgttatcttaggaccttacagagatatccgcgaaggtgatgaggtcaaaagaacgggccgcatcatggaagttcctgtaggtgaagaattaatcggacgtatcgtcaacccgctcggacagccggtagacggactgggtccgattctgacaagcaaaacacgtccgatcgaaagccaggctccaggcgtaatggaccgtaaatcggtacatgagccgctgcaaacgggtatcaaagcgatcgacgcgttaattccgatcggccgcggacagcgtgagctgattatcggggaccgtcagacaggtaaaacatctgttgcgattgatacaatcttaaaccaaaaagatcaagacatgatctgtgtgtacgtagcgatcggccaaaaagaatctacagtacgcggcgtggtggaaacacttcgtaagcacggcgcgcttgattacacgattgtcgtgacggcatccgcttcacagccggctccgcttctttaccttgcaccgtatgcaggggtgacaatgggtgaagaattcatgtacaacggcaagcacgttctcgtcgtatatgatgatttatccaaacaagcggccgcttaccgtgagctgtcattgcttcttcgccgtccgccgggccgtgaagcattccctggggatgtattctatcttcactcccgtctgcttgagcgcgcagccaagctgagtgacgctaaaggcgcaggatcaattacggcgctgccgttcgtcgaaacacaagcaggagatatctccgcttatatcccgacaaacgtcatttccattactgacggacagattttccttcaatccgatctattcttctcaggcgtgcgtcctgcgatcaatgccggattatccgtatcccgtgtcggcgggtcagcccaaatcaaagcgatgaaaaaggtagcgggaacattgcgtcttgaccttgcttcataccgtgaacttgaagcattcgcccaattcggatctgatcttgaccaggcgactcaggcgaaactgaaccgcggtgcgcgtacagttgaagtgctgaagcaagacttgaataagccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggcttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgggagatgccgattttgtctgagttagtggggcttggcgacgaggtcacttttgctcagattaaagatttgacccgtcagacggttcaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcttacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgactgataatgcgaaagaactcattgattcactttcgctttcatataaccgcgcgcgtcaagcggcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggcgatgatacagtccgtacaattgccatggcatctacggacggaattcagcgcggaatggaagccgttgatacaggtgcgccgatttccgttccagtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacgggaattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggtcttcggacagatgaacgagccgccgggcgcacgtatgcgtgtagcactgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactacactgacccggctccggcgacaacgttcgctcacttggatgcaacgactaaccttgagcgtaaattaactgaaatgggtatctaccctgcggttgatccgctggcttccacttcccgcgcgcttgctccggaaattgtcggagaagagcattatgcggtggcgcgtgaagttcagtcaacgcttcagcgttacaaagaacttcaggatattatcgcgattctcggtatggacgaattaggtgaagaagacaagcttgtcgttcaccgcgcacgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcaaaagagatgggtgtagaagtttaatctggtcctaggagggtaaaagcatgaagaccgttaaagtcaatatcgttactcccgacggcccagtatatgatgctgatattgaaatggtgagtgtaagagccgagagcggtgatctcggtatcctgcctggccatattccgaccgtggctccgcttaaaatcggcgctgtccgccttaaaaaagacgggcagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgttacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcaccgtccgtatacggataaggtttgacgacccattcggcatcgtcatgatgtctgatggcgcaatcgatgacatacacactgagcattttctcaaattcgtcaatcggcaggttccaatccgccaaaagcagctcttttatgctgcggaagtaaagagcttccactgccagcaggctgccgggtgaataatcaagagaaatgttgaaaaactgacataattctttcagttcctctgtttgagactgtctataatcatagtagaatgctatcgcttcccactcgtggtcaaatacgggaagtgtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatggaatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgccaacttctttttagattatcttacctattcgaaacagcttccatacttattttaagatgtttcgtctgttgaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgtatcatcttgttttttgtttttttaagcgccttaatagcggtatttcattccattcatgcaagtgagctgtctccgcttgcccagattgccgaaggaatggagcggcagcaggtcactgtggatgaatggacgcttcatgcgaaaaaaaatctgaacctgtcactgagtgaatttgatgacaaggtaaaagaactgaagacgcagtatccgcaatatcattgggaatccgcgcgggaagataaaatcgtaaaggccgtcggcacgtattctgacaaaaaaaatcacacaacttttaaactgcagctcgtcactaccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtctaaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcggaaaacataccgttacggttggcacaccaatcgtgacaactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaattaatgaagtgttgcgtcatttaggagcagatgtgcattttgagaataatgaagttaccgtaaacgcttcttacgctttagaaacagaagcaccttttgaatatgtgcgcaaaatgcgcgcgtcagtgcttgttatgggccctctgttagctcgtacgggtcattcaagagtagcgcttccgggcggttgcgcaatcggctcaagaccgattgatcagcatttaaaaggctttgaagcaatgggtgcaaaaatcaaagtaggcaacggctttattgaagcagaagtggaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcgcggcgtaagacacaacatcattcctgaccgtattgaagcgggtactttcatggtggctgcggctatcacggaaggaaatgtattagtcaaaggtgcggttcctgagcatcttacgtctttaattgcgaaaatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgcgtcacggaactgaagcacttggatcgcggttatgtgaatttccataaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgattttcaaaaaagaatacgtttttcgcgtgaaaaatggaataagattctgtccaaaaggaagtcatattagcttgtccctgcccataagatgaagtagagtcgaatcccaagcaggaggcagctgatatatgaaaccgattgtatttctactatccgggctgtgtatacttattcttcttgttcccaccattctcgttcttccgtttcaggcggaaaaaggagcagccgtaaacagagagcccggacacaaaacaacacacaccacacgagaaacaaaaggagcagaaacattgaaagaatcacctgtatccattccggtttatcggacatccaatcattctgtagagaacattccgcttgaagagtacgtgatcggtgtcgtggcttccgaaatgcccgcaacctttaaaccggaagccttaaaagcccaggcgctcgccgcccggaccttcatcgtcaggctgatggtcgctgactcagccgttcaggcgccgaaaggatcactggtggacgatacgcaaatgttccaagtctatcaaagcaaaagtcagctgaaaaaagaatggggttctaagtacgcacacaacctcaagaaaatcacaaacgcggtcgcaggcacgcaaggaaagattttaacgtacgacaacaagccgattgaggcatctttcttctctacgagcaacgggtatacggaaaatgcggaagcctattggacaagcgccattccttatttaaagagcgtgaaaagtccgtgggataagcattcgccgaaatatctcgccacccagaccttcagtgtgccggagtttcagcaaaagctcggcgtacagctctcgggacaaaacacggtagggcagattacagccagaacgccgggccatcaagtggcgacggccgtcataaacggcaaaaagctgaagggaagagacatccgggaaaaactcggactccgttctgccgactttgaatggaaacggaacggcggcagcatcaccattacgacaaaaggattcggccacggcgtcggcatgagccagtacggggccaattacatggcggagcaggggaaatccgtggcggacatcgtcaagcattattatcagggagtggacatatccgaagcagattcatttttaaacaaatatatggcgaaaaaatagacgctttcatgagcgtctgtttttttgaaaactattccataaacggtaaagcaaccaacagactcatataacgaaagcctaaaggctgacaaatgccgtctgaaggctgagcgccgggtgaaaatcactgataaaaatgccgtatctatgtgaatatacgcaaaaataatgaggaacgccgtcctatttatttcccttttcatctcatttacgataaatgttgttcggcgttgaacgtaaatctattgaaaaggggaagaagcaatgaaaaaaacactttcactcataatcatgctcggattgatgctgactgctgcatctcctgcttttgctgccgagaatgcaaacgagaagacatttttatttaaaaacaatatcgccattttgcttgatgcgagcggcagtatggcgaaacggattgacggcgtttctaaatacaatatggcaaaagatgaaatcgtccgttttgcagatcgaattaagtctacatcacaggtcagaatgacggttttcggttcggaaggcaataataaaaactccggaaaagttcaatcttgtgaatccattcgcggtgtatacggattccaaaagtttgacagacagagcttcctcaactctctgaacggaatcgggcctacgggctggacaccgattgcaaaagcattagaagatgcgaaggcttcttttaacggcgttcataaattcggctttaaatccgtttacctgttgacggacggtgaggagacatgcggcggagatcctattaagacagcgaaagaacttcgcaaacatcatattaaagtcaacgtaatcggctttgactttaaagaaggcttcaacggacagcttcacgcaattgccggtgcgggcggaggaaaatattacgaagctcacagccaaaaggatatgaaccgcatctttacgatggaagcgagttcattagcgaaataagaaaaggtgccgtttagcggcccttttttttatttttatttaacaaaaatttcaagaaaagatgaagagaaaactgtaaaaagaatcagattccggacttatattacaaaaagggcgaaaaaggcattaaatctgtcatcatttatccaatctttttaggatgatgcgcataattctgttcatttttaacggcgtacagccgcttatacaaaaggaatcccgccctatatctttttgcatactcctcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgtcgccgtgctgtttgacgcaagcgggagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaacgcgacagaaacgttatacggccttcagccgtacgccgtgactccatttgagcaatcactcagcaagattaaaccaaccggctggacaccgatagcgaaagcgctttctgatacacgtgaagaatttgagcgggccggcgctaaagggaaaaacgtcgtatatctgatcacagacggtgaagaaacatgcggcgggaatcctcaagccgaaattcaaaagctccgtaaagcgaatgtcaacacggtcgtcaatatcatcggcttcaacttcggcatgaaaggaagcgaaagccttgaaaaagcggcggaagcgggaggcggcacatacgtctcagctgacagcgcggacgagttcaaacaggcttgggaagacgccgcaaaggatttagcaaaagaataggttaaaaaaggacgcccgtgcggcgtctttttttgtttagaaaacggaaccgcgggaatgatacggataaaaggagatgaacgctgttgttaaaaggagcaggcattatattggtgctggcggcagtcgtttttgttctgatagggatttttctgaagcttgccgccttcatattcgtcagtatattggccattatcgccgcagttattttattcaccattctgagcagacatcatcgcaatgaaacatagagtccgaagagggctctttttttaaaccgcaaattcgacaaaatacagggattgtggaagaataaaagagaaggatactgcggaggggaaaacagtggatgaaaaaacaacagcggtaagagacatataccgctatgaaaaaggggtattaacaaagacggcagatcggatggtttcagagtatccgcttaccgtcatggtgaacgggcaggaatttgttacgctcgtctgcacgcctgaccatttagaggaactcgtcatcggatttctcgcatcagaaggcgtcattcgttttgaaaaagagatcaaaagctttactatagatgaaagtctcgggttcgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccggattaccataactcctgagacgtgccttcgcctgatgaaggagatgcaaagcggaagcggcaccttccgggaaacgggcggcgtccataatgcagcgctgtgcgatacggaaaagctgctcttgatgaggacggatatcgggcgccacaacgcgctggataagctgtacggctgctgtttgaaaaacggaatgcccgtccgtgacaagctgatcgtcttcagcggccggatttcctcagaggttttattaaaagccgcaaaaatcggcgtgtcgattgtcatttcaaaatcggcgccgacggagctcgcgctgcaaatggcggaagagctgaacatcaccgcgatcggttttgtcagaaacggatcatttaacgtatacacacatcctgaacgggttgaacaatagaaaggggtcttgggcttatgaatacagaaacgcgccgggtgacagacaaaaaggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacaggcggagagccgctcatgagaaaagatatgcctgaattgatcaaaaaacttgcgcgcatccccggacttaaagatatcgcgatgacgacaaacggctctctgcttcccgtgtacgcggaaaaactgaagcaggcggggctgcatcgagtgacagtcagcctcgattctttagaggatgagcggtttaaggccattaacggccgcggcgtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaagggtcatattctccggtttattgaatttatggatgtaggcaatacgaatcaatggaataaaaaagacgtgatcacgaaggccgaaattattgatctgatcaaccagcacatgccgacggagccgatagaagcgaattacaaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcacggatcagtattcaattgaccgcgcgctttctaaaacggatggaaaaaagaaagtggaaatgtcttatataggcggatgaagaaaagcttgcccggacaagggcaggcttttttattcacaatatgagagcggtctgttcaaaaaataccggtaacagccgaaatatatgataggaattttgatgcaggacaatcaagttatgcaattccaaagccatacaatatgttaaaatataaccaatagaaattagaaaattttttttcaagcagaagacg

SEQ ID NO: 125 - DNA, 59586 bp, Bacillus velezensis FL50S
agagtaggacgccgccaagctatcattacggtaaaggcagctcatcatgagctgccttttttgtgtttttctgcatacgttatatagtatgagaaaagtaacgatatggctttttgcaaaagcaggttttatgcttgtgtaaagtggaaataatagagatagagcgatacagttgaaaaattttgcgaaacaccttatagtaagattaaagtcaaatatagtcaaagtcaataaaggagggggttgagtgggacataatatttctgacatcattgaacagtacttgaaacaagtattagatcaaaatggcaaagaaattttagagatcaaacgcagtgaaatcgctgataaatttcaatgtgttccttcccaaataaattatgtcatcaacaccagatttacaagtgaaagaggatatattgttgaaagtaaacggggaggcggcggttatattcgtattatcaaaattaaaatgaataacgaagtcgtcctcatcaataatattatttcgcagattcatacccacttgtcccaggcagcctctgatgacattattctcagactgttagaggacggagttatttcggaaagagaagctaaaatgatggtgagtgtaatggatcgttcagtgctatatattgatttgcccgaacgggatgaactaagagccagaatgatgaaagcaatgctcacatctttaaaactaaagtaagcgggtgaaaagattgatttgtcaagaatgcaatgagagaccggccacttttcactttacgaaagttgttaatggagaaaagcaagaagttcatatttgtgaacaatgtgcaaaagaaaatagcgattcatacagtataagtggaaaccaagggttctcaattcataatttattatcaggactgctgaatatggagtcctcatttcaaaacaccggttctcaaatgttcggctactcagagcaaggcacagcttgtaagaaatgcggtatgacgtttcagcagctgagaaaaacagggcgtttcggctgtgcggaatgttacgatacgttctacagccaaattacgccgatcttgcgaaaagttcacagcgggaatacggtgcatgccgggaaaattccaaaacgaataggcggaaacctgcatgtaagacggcaaatggaaatgttaaaaaaagaacttgaatctttaatacaccacgaagagtttgaaagagcagcggaggtcagggatcagatccgatcgttagagcaggaattaaaaagtacagacagtgagggggaacaagggtaatgtcgctcaagcattttattcaggacgcactaagcaattggatgaagcaaaagggacctgaaagtgacattgtactcagcagccgtatacggttggcccgaaactttgaaaatataaagtttcccgcccggtatacgaatgaagaagcctcatccatcattcagcaattcgaagatcatttttcaggtaaggaactgcctgatatcggtcaatttcatttaatcagaatgagtgaagctcagcctttggaaaaacgggtgctgatggagaaacatctgatcagcccgaatttaacggaatctccttttggcggctgtctgctttctgaaaatgaagaagtcagcattatgttaaatgaagaagatcatatcagaattcaatgcctcttccccggcttccagcttctcaatgccataaaagcggcaaaccaggttgatgactggattgaggagaaagtggattacgcctttggagagaagagagggtacttaacaagctgtcctacaaatgtagggacgggactaagggcttcagtcatgatgcatttgccgggccttgtattaactaggcaaatgaatcgaattataccggcaattaaccaattaggcttagttgttagaggaatttacggtgaaggcagcgaagcattaggaaatatctttcaaatttcaaatcaaatcacactcggaaaatcagaacaggacattgtagatgatttaaacagtgtggctgcccagctgattgagcaggaacgttcagcccgagaagcgctttaccaaacttcgaaaattgaattggaggaccgggtattcagatcttacggcgttttatccaactgccgtatgattgaatcaaaggaaacggcgaaatgcctttctgacgttcgactggggatagaccttgggatcatcaaagggctatcaagcaatatacttaatgaactgatgattttgacacagccgggttttctccagcaatattcgggcggtgcattacggccgaacgaaagagacgcgagaagagcggcgcttatcagggaaaggctgcatttagaaatgagtgcaaatagacaggaggatgattcgatatgatgtttggaaggtttacagagcgagctcaaaaggtattggcactggcacaggaggaagcactgcgcttaggccataacaatattggaactgaacatatcttattaggtctggttcgtgaaggagaagggattgcggctaaagcactccaagcactcggactcggttcggataaaattcagaaagaagtggagagcttaatcggacggggacaggaaatgtctcaaacgattcattatacgccaagagcaaaaaaagtcattgagctcagcatggatgaagccagaaagctaggacattcttatgtgggaacagaacacatacttctcggattgatccgtgaaggagaaggcgtggcggcgagagttctgaataatctcggtgtcagcttgaataaagcgagacagcaagtgctgcagcttctgggaagcaatgagacggggtcttctgcatccggtaccaacagcaatgcaaacacgccgacgcttgacagtctggcgcgtgatttaactgcgattgcgaaggaagacagtcttgatccggttatcgggcgaagcaaagaaattcagcgtgttattgaggtattaagccgcagaacgaaaaataatcccgttcttatcggagaaccgggtgtaggtaaaactgcgattgctgaaggcctcgcacagcagatcatcaataatgaagtgccggaaattttacgtgataaacgcgtaatgacgttagacatgggtacggttgtagccggtacgaaataccgcggagaatttgaagaccgcttgaaaaaagtaatggatgaaatacgtcaggccggcaatattattttattcattgacgaactgcatacactgatcggagcggggggagcagaaggtgcgattgacgcatcgaatatcttaaaaccttcactggcccgcggagagcttcaatgcatcggtgccacaacgcttgatgaataccgtaaatatatcgaaaaagacgcggctctcgagcgccgtttccagccgattcaggtggatcagccgtcagccgatgaaagcattcaaattttaaaagggctccgtgaccgctatgaagcgcatcaccgcgtatccattaccgatgaagcgatcgaagccgcggttaaattgtccgaccgttatatttctgaccgcttccttccggataaagcgatcgatttaattgatgaagccggttcaaaagtgcgtctccgttctttcacaacgcctccgaacttaaaagagcttgagcagaaactcgatgaagttcgcaaggaaaaagacgctgccgttcagagccaggagtttgaaaaagcggcttcccttcgtgatacggagcagcgcctgagagaacaggtggaagacacgaaaaaaacctggaaagaaaaacaaggccaggagaactccgaagtttctgtagaggatatcgcgatggttgtatccagctggaccggggtgcccgtatctaaaattgcccaaacggaaacagataagcttctcaatatggaaagcattctgcattcccgcgtcatcggccaggatgaagccgttgtagccgtggcaaaggctgtcagacgtgcaagagccggactgaaggacccgaaacgtccgattggttcattcatcttcttaggccctacaggcgttgggaagacagagctggcaagagcgctggcggaatccattttcggtgatgaggaagcgatgatcagagtggatatgtccgaatacatggagaaacactcgacttcacgtcttgtcggttctcctccgggatatgtcggctatgatgaaggcggccagctgacagaaaaagtgagaagaaaaccttactctgtcgtattgcttgatgaaattgaaaaagcacaccctgatgtgtttaacattctcctgcaagtgcttgaagacggacgcttgactgattcaaaaggacgcactgtggatttccgcaacacgatcctgattatgacgtcaaacgtcggggcgagcgagctgaagcgcaacaaatatgtgggcttcaatgtccaggatgaatcacaaaaccataaagacatgaaagacaaagtcatgggagagttgaagcgtgccttcagacctgagtttatcaaccggattgacgaaattatcgtcttccactcccttgagaaaaaacatcttacagacatcgtgtcgcttatgtctgatcagttaacaaaacgtctgaaagaacaagatctctctatcgagctgacggatgctgccaaagcaaaagtagcagaagagggcgtcgatttggaatacggcgcacgcccgttaagaagagcgattcaaaagcatgtggaggaccggttatcagaagaactcctcagaggcaatattgataaaggccagcacattgttcttgatgttgaggacggcgaatttgtcgtaaaaacaactgctaaaacgaactaatatagtgacaaacatgaggcatacgtaagcgagtgtatgcctcactttgttatatagagaaatattcgataaggaagaggtcttacaacatatatggctaaatcaaaaacaaaattcatctgccactcatgcggttatgaatccgcaaaatggatgggaaagtgcccgggctgcggggcttggaatacaatggtggaagaaaccataaaaaaagcgccggcgaatcggcgggcggctttctcccactccgttcaaaccgtccagaaaccatcacccattacatcaattgaaacatcagaagaaccccgcgttcaaacaaagctcgaagaattcaacagagtgcttggcggcggcgttgtgaaaggctcgttagtattgatcggcggcgatcccgggatcggaaaatcaacgctccttctccaagtatccgcacaattagcagatacggccggcagcgtgctttacatttcaggggaagaatccgtgaagcaaacgaagctgcgcgccgacagacttggaatcaacagccaaatgttacatgttttatctgaaaccgatatggagtatatttcgtctgctatacaagagatgaaacccgcatttgttgtcgtagactccattcagaccgtttaccaaagtgatatcacctcagctcccggcagtgtatcacaagtaagagagtgtacggccgaattgatgaaaatcgcgaaaacaaacggcatacctatttttatcgtcggacacgtcacaaaagaaggatcgatcgcagggccgagattgcttgagcacatggtcgataccgttctatactttgaaggagagcggcatcatacattccgtattttgcgggccgtaaaaaaccgtttcggctcaacaaatgaaatgggcatctttgaaatgcgggaagaggggcttacggaagtgctcaacccttctgaaattttcttggaagagcgttctgccggggcatcgggttcgagtatcgttgcgtcaatggaaggaacgagaccgattctggttgaaatccaggcgctcatatcaccgaccagttttggaaacccgcgccgcatggctacaggcattgaccacaacagggtatcgttaattatggctgtgcttgagaagcgggtgggtcttttgcttcaaaatcaagatgcatatttaaaagtcgccggcggggtcaaactggatgaaccggcgattgatttggcagtagccgtcagcattgcctcaagcttcagagatacaccgccgaatcccgcagattgctttatcggtgaagtgggtctgacaggagaagtccgcagggtgtcaagaatcgaacagcgcgtaaaagaagcggcaaaactcggcttcaagcgcatgatcatacctgaggcgaatgcagacgggtggacaataccaaaagggattgaggttgtcggagtagcaaatgttgcagaagcgcttcgtacttcattaggaggatcataatagatggaaaaagagaaaaaaggggcgaaacaagagcttgacctgtctgcaattctgcagttcgttgcaccgggcaccccgctcagagccgggatagagaatgtacttcgggcaaatacaggcggcctgattgttgtcggatacaatgataaggtaaagcaagtcgtcgatggcggttttcatattaatacatcatttgcgcccgctcacttatacgagctggccaaaatggacggtgccattattttaagtgattccggccagaaaattctttatgcgaatacacagcttatgccggaggcgaccatttcttcttcagaaacgggaatgaggcaccgtacggcggaacgggtggcgaagcagaccggctgtctcgtcatcgccatttctgagcgcagaaatgtcattacgttatatcaggacagcatgaagtacacactaaaggacataggttttattttaacaaaggcaaatcaggccattcaaacgctcgagaagtataaaaccattttagacaaaacaattacggctctaaacgcattagagtttgaggagcttgtgacattcagtgacgtgctgtctgtcatgcatcggtatgaaatggtgctccgaataaaaaatgaaatcaatatgtatattaaagaactcggaacggaaggccacttaatccgtctgcaggtgattgaactgattacggacatggaagaagaggcggcacttttcatcaaagactatgtcaaagaaaaaatcaaagatccgttcgtgctgttaaaagagctccaggatatgtccagctatgatctgctggatgattccattctgtttaaactgcttggatacccggcttctacgaatcttgatgattatgtgctcccgagaggctacaggctgctgaacaaaattccgcgtctgccgatgccgattgttgaaaatgtggttgaagcgttcggatttttgcccagcataacggaagccactgtagaagagcttgatgatgtcgagggtatcggcgaagtccgcgcccaaaaaatcaaaaaaggcttaaaacgccttcaggaaaaacactatatagatagacagctttaagtatcgcttaaacctgtcggaatccgggtatattattgttagtttttgtttattctgaatttgtaggctctgacagtctgctgaaaaaatgctacttaaaaggaggtggaggtatgttaaaacgaatagttcaggcgttcttcattattgtgggcggcgttgtcgggatctttttaatacctgaattgtttgtgctgtcaaatatacaggacatacctttaataacaaacgcatatacgtctgctgcaattggtgctattatcttttttctcatcagtatatggacgacagaatatgtgattaattgggtaaaatggattgaagattctttgctgagagctccggtgccggatctgttattcgggagtctcggattggtttttggacttatcatcgcatacctcattgtaaacgtgattccgctggacaatattccgtaccgtatattcagcaccatcattccggtctttctggctttctttctcggttatctgggcttccaagtcggatttaagaaaaaggatgaactgatcagtcttttctccatttctgcaagaatgcagaagaaaaagggaagtgctgatgaggagcaggaagaacaggataaaaggctgaaaatcttggatacaagtgttattattgatgggagaattgcagatatttgtcagacgggctttttagaaggcgtcattgtcattcctcaatttgtgctggaggaattacagcatatcgctgattcttcagatgttttaaaacgtaacagaggacgccgcggactggatatcttgaatcgcattcaaaaggaactggatattacggttgaaatttatgaaggcgacttcgaagacattcaggaggttgacagcaagcttgtcaaacttgcgaagctgacatccggtgtcgttgtgacgaatgattttaatttaaataaagtatgcgagcttcaaaaggttgcggtactgaatattaatgaccttgcaaacgcggtgaagccggttgtgcttccgggcgaagagatgaatgtgcaggtgattaaggacgggaaagagcataatcaaggtgtggcttacttagatgacggcacaatgattgttgtggaagaaggccgcaattatatagggaaacatattgatgtgctcgtaaccagcgtactgcagacagcggcgggacgaatgatttttgccaagcccaagctgcttgagaaagctctttaagagggagttcatatggagtatgttgtcgttattccggctgccggacaaggaaaacggatgaaggccgggaaaaataagctgttcatcagcttaaaaggtgcgcccgttattatacacacactgcgggtttttgaaagccacgcaccctgtcagaaaataatcctggtgataaacgagagtgaacgggaagattttcgccagctgctggcccaatttccgattcagacggaaattgagcttgttaccggaggtgcggagcgtcagcacagtgtatacgaaggactgaaagtgattgataaggaatcggtcgtgcttgttcatgacggagcgcgcccgtttgtcacacatcagcatatcgataagctcgttgaaacagcagaggaggcgggagcggctgtcctggctgttcctgtgaaagacacgataaaacgggcggaaggctcccgggctgcggagacctttgatcgttcaagcttgtgggccgttcaaacgccgcaagcttttcgtctttctttattgaagacggcgcatatggaagcggaaaacaaaggcttcttaggtacggatgacgccagcctcgtcgagcgtcttgatggatatcaggtgagtatcgttgaaggcagctataccaatattaagctgacaacgccggatgacctgatatttgcggaagcaatcatgaaagcggaaagtgggaatcataatgtttagaatcggacaaggatttgatgtgcatcaattaacggaaggccgtccgctcatcatcggcggaattgaaattccttatgaaaagggactgctcggacattcagatgctgatgtattgctgcatacagtcgcagacgcgtgtctcggagcggcaggtgaaggagatatcggcaagcatttcccggatactgatccggaattcaaggatgcggattcttttaagctgcttcagcatgtctggaacattgtaaaagaaaaagggtacgtactcggaaatatagactgcacgattattgcgcaaaagccgaaaatggcgccgcatattgatgctatgagaaaacggatagcggaaggccttgaggcggacgtctctcaagtaaatgtaaaagcgacgacgactgaaaagctcgggtttaccggaagagccgaaggaattgccgctcaggcaaccgttctgattcaaaaagcctgatcattgttttgatgccgggtctatttggtggtagaatagatacatatattcggctagaggctacagacgagatgaaaggaagtatttgaacatgggaaatgaagtacgcgttcgttatgcaccgagtccgaccggacatttgcatatcggtaacgccagaacggcgctttttaactatttatttgcccgcagccaaggcggaaagtttattatccggattgaggatacggacaaaaagcgaaatattgaaggcggagagcaaagtcagctcaactatttgaaatggctcggcatggactgggatgaaagtgtggatgtcggcggagaatacggcccgtaccgccagtctgagcgtaacgacatttacaaagagtactatgaagagcttcttgaaaaagggcttgcttataaatgtttctgtacggaagaagaacttgaaaaagaacgtgaagagcaaatcgcccgcggggaaatgccgcgctattccggcaaacacagaaacctgactcaggaagagcaggagcagtttttagccgaaggcagacagccgagcatccgtttccgcgtgccggaagggaaaatcatcgcatttaacgatatcgtaaaaggcgagatttcttttgaatcagacggcatcggcgactttgtcatcgtcaaaaaagacggaacaccgacgtataactttgccgtcgcgattgacgattacttaatgaaaatgacgcacgtgctccgcggtgaggatcacatttcaaatacaccgaaacagatcatgattttccaggcattcggctgggatattcctgtcttcggacatatgacgcttatcgtaaacgaaagccgcaaaaaattaagtaaacgtgatgaatcaattatccagtttattgagcagtatgatgagctgggttacctgcctgaagcgctgtttaactttatcggacttctcggctggtctcccgtcggtgaagaagagcttttcacaagagaacaattcattgaaatttttgatgtaaatcgtttgtctaagtcaccggctctgtttgatatgcataaactgaaatgggtcaacaaccaatacgtcaaagcgctggatcttgatcaagtggttgagctgaccctgccgcacctgcaaaaagcaggaaaagtcggcactgagctttctgccgaagaacaggaatgggttcgtaaattaatctctctttaccatgagcaattgagctacggcgctgaaattgtcgagcttactgatttgttctttaaagatgagatcgagtataatcaagaggcaaaagccgttctggaagaagaacaggtgcctgaagtgctcagcgtatttgctgcgaagcttgaagagcttgaagaatttacgcctgagctgatcaaagcctcaatcaaagctgttcagaaagaaacaggccataaaggcaaaaagctgttcatgccgattcgtgtagcggttaccggtcagacacacggtccggagcttccgcaggccattgagctgatcggcagagaaacagccgtcagacgcctgaaaagcatttaaatatacgattgttgacagggaagagtataaaacaatgaccattacagaaagaatcttcatcggctgagagagattcatgcgtcatgttttagaagtgcgcccttaagacctttgaagaacatttctgcggaaatcagtatttaaaggcggccgccgccgttaccggcttttaagttgggaaaacattgacttgtttttcaaacagagtggaaccgcgcggtaaaagcgtctctgtcatgtttacatgcagaggcgctttttttataggcggaaaaacagactggagcggggagagaatggggggaagcatgtgttttttaaaatgctaaaagaagacatagatacagtgttcgatcaagatccggcagcaagaagctatttcgaagttgttttaacttattctggtttacatgctatatgggcgcatcggattgcacatgctttatataaacggagatttttcttcctggcgcgcctgatatcacagattgcccgtttctttaccggaattgaaatccatcccggcgcgaccatcgggagaaggtttttcattgaccacggtatgggggtcgtcataggggaaacatgtgaaatcggcaataacgtgacggtattccaaggtgtcactctcgggggaacgggaaaagaaaaggggaagcggcatccgaccataaaagatgatgctttaattgcaaccggagcgaaggtgctcggctctattacggtcgggcaggggtctaaagtaggggccggctccgttgtgcttcgtgatgttcccgacttttcgaccgttgtcggcataccggggaaagtcgtcattcagaacggaagaaaaatcaaacgcgatctcaatcaccaagacttgcccgatccggttgctgaccggtttagagcattggagcagcagatttttgaactgcaggctgaactggaagataaaaaagaaaggatcaaccaaaaatgaccattacactttataatacattgacacggaaaaaggaaacattcgttcctcttgaggaaggcaaagtaaaaatgtacgtgtgcggacctactgtatacaactatattcatatcggaaacgcccgtccggcgattgtgtatgataccgtacgcaactatttggagtataaaggatacgatgttcaatacgtatcgaatttcaccgatgttgacgacaaactgattaaggcggccaacgagctcggcgaggacgtcccgaccgtttctgaacggttcattaaagcgtattttgaagacgtgggcgccctcggatgccggaaagcggatcttcacccccgggtcatggaaaacatggacgccattattgaatttgtcagcgagctgattaaaaaaggctacgcttatgaatcagaaggcgacgtctatttcaaaacaagggccttcgaaggctacggcaagctatctcagcaatcaattgatgaactcagatcaggcgcgcgtatccgtgtcggcgagaagaaagaggatgcgctggactttgcgctttggaaagctgctaaggacggagaaatttcatgggatagcccttggggaaaaggccgcccgggctggcatattgaatgctccgcaatggtgaaaaagtatttgggtgacgaaatcgatattcacgccggcggtcaggacctgacattcccgcaccatgaaaacgaaatcgcgcaatctgaagcattaacaggcaagacattcgcaaaatactggcttcacaacggatatatcaatatcgataatgagaaaatgtcaaaatcgctcggcaactttgttttggtgcacgatatcattaagcaatatgacccgcagcttttgagatttttcatgctttccgttcattaccgccacccgatcaactattcggaagagctgcttgagaaaacaaaaaacgcgtttaaccgcctgaagacggcatacagtaatttaaaccatcgtttgattagcagcacgaatctgactgacaatgatgaggaatggctcgctaaaatcgaagagcaccgcgcttcgtttgaagaagcaatggatgatgattttaatacggcgaatgcgatttccgtttggtttgatctggcgaagctcgccaattactacatgcaggaagacaatacggcggatcacgtcattaaagcctttatcagcatgtttgacagaatcggatctgttctcggacttacgctcggcgaagaagagcttgtcgacgaagagattgaagagttgattgagaagagaaatgaagcccgccgcaatcgcgatttcgctttgtcagaccagattcgcgatcagctgaaaagcatgaatatcattcttgaagacacagcccagggaactcgctggaagcggggagaataagcggatgcttcaatttgaacaaatcaaagattcaaagcagttaaacggtcttgcgcttgcttatatgggtgatgccatttttgaaatatacgtccggcatcacctgcttaagcagggctttacgaaaccgaatgaccttcataagaaggcgagccggattgtatcggcaaaatcacaggcagacatattgttccgccttcaggacgaatcctttttcacggaggaagaggaagccgtgctgagaagaggcagaaacgcgaaatcagggaccacgcctaaaaacacagatgtacagacgtaccgccatagtacagcttttgaggctttactcggatacctttttcttgagaaaagagaagaaagactgaatcagctgattgctgaggctatacaagtcgggacgtcagggaggaaaacaaatgagtcagcaacatgattacgtcataggaaaaaacgctgtgattgagacgttaaagtcagatcgcaagctgtataagttatggatggcggaaaacacagtaaaaggacaggcgcagcaagttatggagcttgctaaaaagcgcggcgtcaccattcaatttgtaccgaggaaaaaactcgatcagatggtggaggggcagcatcagggtgttgtcgcccaggtggcggcatatgaatatgcacaattagacgaattatataaaagagcggaagagagaaacgaacagcctttctttctcatattggacgagctggaagaccctcataatctcggttccatcatgagaacggctgacgctgtcggtgcacacggcattgtgattccgaaacgcagagcggtcggactgacatcgacggtcgcaaaagcttcgaccggtgcgattgaacacattcccgtcgtgaaggtgaccaaccttgcccggacacttgatgaaatgaaggagcgggggatttgggtcgtcggaacggatgcatccgcccgggaagactaccgctctatggacggcaagatgcctttggcgctcgttatcggaagcgaaggcagaggaatgggccggcttgtgaaagagaaatgtgattttctcattaaacttccgatggccggaaaagtcacgtctctgaatgcgtcggtagcggccggccttctcatgtatgaagtctaccggaagcgcaatcctttaggggaataaagacagatggacatcctgttagtagacggatacaacatgattggagcttggccgcagctaaaggatttaaaagcgaacagttttgaagaagcgagagatgtactgatccagaagatggcggaatatcagtcctacacgggaatcagagtcattgtggtgtttgacgcacatctggtaaaaggcatagagaaaaaacaaacgaatcacagagtcgaagtgatttttacacgggagaatgagacggcggatgagcggatcgagaaacttgcccaggcgctgaataatattgcgacacagattcatgtcgcaacctccgattatacggagcagtgggcgattttcggacaaggggctctccgcaaatccgcccgggagcttctgagggaagtggatacgatagaacggcggattcaaaggcgggtttcaaagatcacttctgaaaaaccaccgggtaaaatcgagctgtccgaagaggttttgaaaacgtttgaaaagtggcgccgaggcggtctggattaggttgacgctttttcgcccattaatgtataatatttctatctacgtgcgccggggggatcgcagtgaatctacagaacagcaagggaaagttcaacaaagtgcaattttgccagttggaggacgagcaggtcattgaaaaggttcatgttggggatagtgatgcgttagattacttgattacgaagtaccgtaattttgtacgggcgaaagcaaggtcttattttttaataggggccgacagagaagatattgtacaggaagggatgataggcttatataagtctatccgagattttagagaagacaagcttacttcatttaaagcttttgcagaattatgcattacccgccagattattaccgcaataaagacagctacccgtcagaaacacattcctttaaattcctatgtttctttagacaaacctatttttgatgaagaatctgacagaacactgcttgatgtcatttcaggcgctaaaacgttaaatcctgaagagatgattattaatcaggaagaatttgatgatatcgaaatgaaaatgggagaactgctgagcgatctggagagaaaggtgcttgttctgtacttggacggaagaagttaccaggaaatttcagatgatttaaaccgacacgtaaaatcaatcgataatgccctgcagcgcgtgaagcgcaagcttgaaaagtatttggaaataagagaaatcagtctgtagcgggtttctgtgtcatattgacagaatttttctgactgtgctattttattaagataaatgattgtttaggaaaaggtgtaacgacatgagaaaaaagattacgctggcatgcaaaacatgcggaaatcgtaattatacgacaatgaaaagctctgcatcagcggctgagcggttagaagttaagaagtactgcagcacttgcaattcacatacagctcatttagaaacaaaatagtgttcgctttttaaattgtggaggtcttttacatgcgcatgatgagtttctttaaagatgttgggaaagaaatgaaaaaggttagctggcctaaaggcaaagagttaacgcgctatacgatcacggtgatttcaacggttatcttttttgttatcttttttgccctccttgatacaggaatttctcaattaattcgtttaatagttgaataatgatcagcaatacgtgctataatagatcataatatcgtttgccaaaacccgttcagcgggttttttattgtgttgaaaaaaggattcataggctctgagcctattttttgttttacacttcatttttaaatgcggggagggaaggactgcagagtcctgatagaatggaaaagaattggtatgttgttcatacgtattccggttatgaaaacaaagtaaaagcgaaccttgaaaaacgtgtggaatcaatgggaatgcaggataaaattttccgcgttgtcgtccctgaagaggaagagactgatattaagaacggcaagaaaaaagtagtcaaaaagaaagtgttcccgggttatgtgcttgttgaaatcgtcatgactgatgattcctggtatgtggtccgcaacacgccgggcgttaccggattcgtcggatcagccggttcaggctcaaagccgactccgcttcttcctggcgaagcggaaaccatcttaaagcggatgggcatggatgagcggaaaaccgacattgattttgaattgaatgagacagtcaaagtcatagacggacctttcgccaactttacaggatcaattgaagagattgattatgataagagcaaagtgaaagtattcgttaacatgttcggccgtgaaacgccggttgagctggaatttacccagatcgacaaattgtaatgtgaaaaaacttgaaattgctatatattaatgataatatagcaaaggtacgtcttggactaatccaaggcagctagcttgatatttcgtcattcatataaagaatgaaaccttgagtgggagggtttaccctattaccacatcacggacttaaggaggtgtgtctcgtggctaaaaaagtagtaaaagttgtaaaattgcaaattcctgctggaaaagctaacccagcgccgccagttggacctgcactaggtcaagccggtgtaaatatcatgggattctgtaaggagtttaacgctcgtacagctgaccaagctggtttaatcattcctgttgaaatttcggtttacgaagaccgttcatttacatttattacaaaaactccgcctgctgcagtattgcttaaaaaagcagctggaattgagtctggttctggtgaaccaaaccgtaataaagtggcaaccgttaagcgcgataaggttcgcgaaatcgctgaaacgaaaatgcctgacttaaacgcagcagacgttgaagcggcaatgcgcatggttgaaggtactgcccgcagtatgggtatcgttatcgaggattaatttgtttcttgtcgggttgcgagttttcacaagttcgcaacccttattcgtgggaggttattccgctataaccacataaggaggaaattttaaaatggctaaaaaaggtaaaaagtacgttgaagctgcgaagcttgtagaccgtgcgaaagcttacgacgtcgctgaagcagtggcgcttactaaaaaaacaaacacagctaaattcgacgctacagttgaagttgcttttcgtttaggggttgaccctcgtaaaaacgatcagcaaatccgcggtgcagttgtacttcctaacggaactggtaaaactcagcgcgtgcttgtattcgctaaaggcgaaaaagcaaaagaagctgaagctgccggtgcagactacgtcggtgattctgattacatcgcgaaaatccagcaaggctggttcgaattcgatgtaatcgttgcgactcctgacatgatgggtgaagtcggtaaaatcggccgtgtgcttggaccaaaaggtcttatgccaaaccctaaaacaggaactgttacattcgaagtagaaaaagcaatcggcgaaatcaaagctggtaaagtagaataccgcgttgacaaagctggtaacatccatgttccgatcggaaaagtttctttcgaggatgaaaaacttgttgagaacttcacaacaatgtatgatacaatcctgaaagcaaaaccggctgcggctaaaggtgtttacgtgaaaaacgttgccgttacttctactatgggccctggtgtcaaagtagacgcttctactttcaacgtaaaataatatttgactttagatcagcattctgatatgattcaaaatgttgtaaaatataatatgtcatttataccgtagacagcaggggccgttgaggcttaatatcctgccgaggtgtatatatatcacagctattacgttacgtatgcttgtatatacagcctccatgtccacatggaggctttttatatgaaatcgtcgtcacagtcgtgatcacctagcggtataagtgttacacaaaatctacaggaggtgtaaccatgagcagcgcaattgatacaaaaaaagttgttgttgaagagattgcttctaaactgaaagaaagcaaatcaacgatcatcgttgactaccgcggacttaacgtttctgaagtaactgaactccgtaaacagcttcgcgaagctaacgtagagttcaaagtgtacaaaaacacaatgactcgccgtgcggttgaacaagctgaacttgatggtttgaatgatgtcttaactggaccgaatgcgatcgcattcagtactgaagatgttgtcgctccggcaaaagttcttaacgagttcgcgaaaaatcacgaagctctggaaatcaaagcgggcgttatcgaaggaaaagtatcttctgttgaagaagtgaaagctcttgctgaacttccttcacgcgatggcttactttctatgttgcttagcgtacttcaagctccagttcgcaaccttgcacttgcagctaaagcagttgcagaccaaaaggaagaacaaggcgcttaatctgattttaccctaaaataaaacaaatggaggaatttcaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggcgctgctgaagagcaaagcgaattcgaccttatccttgctggtgcaggttctcagaaaatcaaagttatcaaagttgttcgtgaaatcactggtcttggcttgaaagaagctaaagaacttgttgacaacactccaaaaccacttaaagaaggtattgcgaaagaagaagctgaagagcttaaagctaaacttgaagaagttggcgcttctgtagaagttaagtaatcttcacttgcctgtaggggaagctcgcttttatgaggcgggctttttctttgcttttctttaagtgcaattaaaaaaggaggttctaataatgagtgaacactattattcagaaaaaccttcagttaaaagcgataaacagacatggtcatttacactgcggaacagatcttatacattcacaagtgacagcggcgttttctcgaaaaaggaagttgatttcggttcgcgtgtcttaattgaagcgtttgaagagccggagatcgatggtgacttcctggatgcaggctgcggttacggcccgatcggtctgtcgctcgccggtgcatttacagaccggaccgtgcacatgattgacgtgaatgaaagagccgtagagctgtcaaatgaaaatgcagaaaaaaacggaataaaaaacgttcggatttatcagagtgatttattttcaaatattgattctgctcaaacatttgcttctattattacaaaccccccaatccgcgccggaaaaaaagttgtccatgccatttttgaaaaaagcgctgagcatttaagggcttcaggtgaattgtggatcgttatacagaaaaaacagggcgggccttctgccattgaaaaactgaaggagctttttgacgaagtttctgtggttcaaaaaaagaaaggctattatatcataaaagcaaaaaaagtttgacttgaattttcagctatgttaatattgtaaaatgccaatgtatatattttgcatgatatgctcaaataatcatagtgcatgtataaattatacaaacatggaaatgctaataaaatcggtatttgtttttggatgtggttttcttaattagaaacccttttttcttttgtcttgtaaaagtatttctttatcgtaagagatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctctagagttcattgactacagtttaggagatcctaagtatcccgttgaagagtcaaaagaacgtgatgtgacttactcagctccgctaagagtgaaggttcgtttaattaacaaagaaactggagaggtaaaagaccaggatgtcttcatgggtgatttccctattatgacagataccggtacttttatcatcaacggtgcagaacgtgttatcgtatctcagcttgttcggtctccaagtgtatatttcagtggtaaagtagacaaaaacggtaaaaaaggttttaccgcgactgtcattccaaaccgtggcgcatggttagaatacgaaactgatgcgaaagatgttgtgtatgtccgcattgatcgcacacgtaagttgccggttacggttcttttgcgtgctctcggcttcggttccgaccaagagattctcgatctcattggtgagaacgaatatctccgcaatacactggataaggacaacaccgaaaacagtgacaaagcgcttcttgaaatctatgagcgccttcgtcccggagagccgcctacagtagaaaacgcaaaaagcttgctggattcccgtttcttcgatccgaagcgatacgaccttgcgaatgtaggacgctataaaattaataaaaagcttcatatcaagaaccgcctgtttaaccagcgccttgcagaaacactggtggatccggaaaccggtgaaattctcgctgaaaaagggcagattcttgacagaagaacacttgataaagtattgccatacttagaaaatggaatcggcttcagaaaactttatcctaacggcggcgttgtcgaggatgaagtgatgcttcaatccattaaaatctatgctcctactgatgcagaaggagagcagacgatcaatgtgatcggcaatgcttacatcgaagaggcgattaaaaacattacgcctgctgatattatttcttctatcagctacttcttcaacctcctgcacggagtgggcgacactgatgatatcgaccatctcggaaaccgccgtctgcgttctgtaggtgagctcctgcaaaaccaattccgtatcggtttaagccggatggaacgtgtcgtacgtgaaagaatgtctattcaagacacgaatacaattacgccgcagcagctgattaacatcagacctgttattgcgtctattaaagagttcttcggaagctcacagctttctcaattcatggatcagacgaacccgcttgctgaattgacgcacaaacgccgtctgtcagctctcggaccgggcggtttgacgcgtgagcgcgcaggtatggaagtacgtgacgttcactactctcactacggccgtatgtgtccgattgaaacgcctgagggcccgaacatcggtttgatcaactcattgtcatcatttgcgaaagtaaaccgctttggtttcattgagacgccataccgccgcgttgatcctgaaacaggaaaagtaacgcctagaatcgactacctgactgctgatgaagaggataactatgtcgtagcccaagcgaatgctaagctgagcgatgacggttctttcttggatgacagcatcgtagcgcgtttcagaggggaaaacaccgttgtagcccgcaaccgcgtggattacatggacgtatctcctaaacaggttgtttctgctgcgacagcatgtattccgttcttggaaaacgatgactcgaaccgcgccctcatgggagcgaacatgcagcgtcaggctgtgcctttgatgcagccggaagctccgatcgtcggaacgggtatggaatacgtatccggtaaagactccggtgcagccgttatttgtaaacaccctggtatcgtagaacgggtggaagcgaaaaacgtatgggtgcgccgctatgaagaaattgacggccaaaaagtaaaaggcaacctggataagtacagcttgctgaaatttgtccgctccaaccaaggtacgtgctacaaccagcgtccgattgtaagtgtcggcgatgaagtagtcaaaggagaaatccttgctgacggaccttcaatggagcttggtgaacttgctctcggccgcaacgtaatggtcggcttcatgacatgggacggttacaactatgaggatgccatcatcatgagtgaacgccttgtgaaagatgatgtatacacatctattcacattgaagaatatgaatcagaagcacgtgatacaaagcttgggccggaagagatcacccgcgatattccaaacgtaggggaagacgcgcttcgcaaccttgatgaccgcggaattatccgtatcggcgcggaagtcaacgacggagaccttctcgtaggtaaagtaacgcctaaaggtgtaactgagcttacggctgaagaacgccttcttcatgcgatctttggagaaaaagcgcgtgaagtccgtgatacttctctccgtgtgcctcacggcggcggcggaattatccacgacgtaaaagtcttcaaccgtgaagacggcgacgaacttcctccgggagtgaaccagcttgtacgcgtatatatcgttcagaaacgtaagatttctgaaggtgataaaatggccggacgtcacggaaataaaggggttatctcgaagattcttcctgaagaagatatgccttaccttcctgacggcacgccgatcgatatcatgcttaacccgctgggtgtaccatcacgtatgaatatcggtcaggtattagaacttcacatgggtatggctgcccgctacctcggcattcacatcgcgtcacctgtatttgacggcgcgcgtgaagaagatgtgtgggaaacacttgaagaagcaggcatgtcaagagacgctaaaacagttctttatgacggccgtacgggagaaccgttcgacaaccgtgtatcagtcggaatcatgtacatgatcaaactggctcacatggttgacgataaacttcatgcccgttctacaggtccttactcacttgttacgcagcagcctctcggcggtaaagcccaattcggcggacagcgtttcggtgagatggaggtttgggcgcttgaagcttacggcgcagcttacacgcttcaagaaatcctgactgtgaagtccgatgacgtggtcggacgtgtgaaaacatatgaagccatcgtcaaaggcgacaatgttccagagcctggtgttccggaatcattcaaagtattgatcaaagagcttcaaagcttaggtatggacgtaaaaatcctctcaggcgatgaagaagaaatagaaatgagagatctagaagacgaggaagatgcgaaacaggctgacggccttgcattatcaggtgatgaagcgccggaagaaacagcatctccagacgttgaacgtgacgcagtaacgaaagaatagtctctgattgataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttgaaacctgaaaaggacggcctgttctgcgaacgcattttcggaccgactaaggactgggaatgtcattgcggcaagtacaagcgggttcgttataaaggcgtagtttgtgaccgttgcggagttgaagtaacgcgggctaaagtccgtcgtgagagaatggggcatattgaactggctgccccggtttctcacatttggtatttcaaaggtattccgagccgtatgggtcttgtattggatatgtcaccgcgtgcgctggaagaagttatttactttgcttcttacgtcgtaactgacccggccaatacaccgctcgaaaagaaacagcttttatctgaaaaggaataccgtgcgtatctggataagtacggaaacaaattccaagcctctatgggtgcggaagccattaataaacttctgcaggacatcgaccttgtcaaagaagttgatatgttaaaagaagagctgaagacttctcaaggacagcgccgtacacgcgcgatcaaacgccttgaagtgcttgaagccttccgtaattcaggaaacaagccgtcttggatgattctcgacgtgcttccggttattccgcctgaattaagaccgatggttcagcttgacggcggacgtttcgcaacgtctgacctgaacgacctttaccgtcgtgtcatcaaccgtaataaccgtttaaaacgtctgttagacctcggcgcgccaagcatcatcgttcagaacgaaaaacgtatgcttcaggaagcagtcgacgctctgattgacaacggacgccgcggccgtccggttaccggaccgggtaaccgtccgcttaaatctctttctcacatgctgaaagggaaacaagggcgtttccgtcagaaccttctcggtaaacgtgtagactactcaggccgttccgttatcgtcgtaggcccgcatctgaaaatgtatcagtgcggtttgccgaaggaaatggcgcttgagctcttcaagcctttcgtcatgaaagagcttgttgaaaaaggccttgctcacaatatcaagagcgcaaaacgcaaaatcgaacgcgtgcagcctgaagtatgggatgtacttgaatctgtcattaaggagcatccggtcttactgaaccgtgcccctactcttcacagattaggtatccaggctttcgaaccgacgcttgttgaaggacgcgccatccgtcttcacccgttagtatgtacagcttataacgctgactttgacggtgaccaaatggcggttcacgtacctttatcagctgaggctcaagctgaggcgcgcattctgatgcttgcagcccaaaacatcttgaaccctaaagatggtaaaccggttgttacgccgtctcaggatatggtattaggaaactactacctgacgcttgaacgcgccggagcagtcggcgagggtatggttttcaaaaatacggacgaagcgcttcttgcttatcaaaacggttatgttcatcttcatacgagagtagctgttgcagcgaactcccttaagaatgtgacatttactgaagaacagcgttcaaaattgttaattacaactgtcggtaagctcgtcttcaatgaaattcttccggaatcattcccttacatgaatgaaccaacgaagagcaacattgaagagaagacacctgaccgtttcttcttagataaaggtgctgacgtaaaagctgtgattgctgagcagccgatcaacgcaccgtttaaaaaaggcattttgggtaaaatcatcgcggaaatctttaaacgattccatatcacggaaacgtctaaaatgcttgaccgcatgaaaaacctcggtttcagatattcaacgaaagccggcatcacagtaggggtttctgatatcgtcgttctcgatgataaacaggaaatccttgaagaagcacaaagcaaagtggataatgttctgaaacagttcagacgcggtttaatcaccgaagaagaacgttatgaaagagtcatttcaatttggagttcagcgaaagatgttatccaaggcaaactgatgaaatcattagacgaagtcaacccgatctacatgatgagtgattcaggagcccgtggtaacgcatctaactttacacagcttgcgggtatgcgcggtctgatggccaacccggctggacgaatcattgaattgccgattaaatcaagtttccgtgaaggtctgacagtattggagtactttatctccactcacggtgcgcgtaaaggtcttgccgataccgccctgaaaacagctgactcaggttaccttacacgccgtcttgttgatgttgcgcaggatgttatcattcgtgaaacagattgcggaacagaccgcggtattcttgcaaaaccgctcaaagaaggcacggaaatcatcgagcgtctggaagagcgtctgatcggacgtttcgccagaaaacagatcaaacatcctgaaacgggtgctgtgctcattaacgaaaatgaattgatcgatgaagataaagcgctggaaatcgttgaagccggaatcgaagaagtgtggatccgttctgcgttcacatgtaacactcctcatggtgtatgtaaacgatgctacggacgaaaccttgcaaccggaactgatgttgaagtcggcgaagcagtaggtattatcgccgctcaatctatcggtgagcctggaacacagttaacgatgcgtacgttccacacaggcggggttgccggagacgatatcacacaaggtcttccgcgtatccaagagcttttcgaagcgcgtaatccgaaaggtcaagcgacgatttctgagattgacggtacaattgccgaaatcaatgaagtccgcgacaaacagcaggagattgttgttcagggcgctgttgagacccgttcatacacggcaccttacaactcacgcctgaaagtgactgagggtgatcagattacccgcggtcaagtgctgacggaaggttcaatcgatccgaaagaacttcttaaagtcactgacctgacaacggttcaggaatatcttctgcatgaggttcagaaggtttaccgtatgcagggggttgaaatcggcgataaacacgtagaagtaatggttcgccagatgcttcgcaaagtccgtgtaatcgatgccggagatactgatgttctccctggcacattgcttgatattcaccaatttacagaagcgaacaaaaaagtgctgcttgaaggcaatcgacctgctacaggccgtcctgtccttctcggtatcacgaaagcttcactcgagacggattcattcttgtctgccgcatcattccaggaaacaacacgcgttcttacagatgctgcgattaaaggcaagcgtgatgaacttctcggcctgaaagagaatgttatcatcggtaaactggttccggccggtacaggtatgatgaattacagaaaagtaaaacctgtttcaaacgttcagccttcggaagatatggttccggctgaataacagaaactgctgcaggaaaggctgtttcgacagcttttcctcagtattacaattattctggcgggggactgcactaaaaaatgtcatacgttgttgacatccgtcccgcagagtgataatataaccaaggtgctcgaaataaaacctgttactttggaggatatgtttatgtcttatgataaagtatcacaggccaaatcaattattattggtacgaagcaaacagtgaaagctctaaaacgaggttcagtgaaggaagtcgtcgtggcaaaagacgcggattcagttcttacggctggcgttatccagcttgcaaagaaccaaaataccgctgtctgtatggtggattccatgaaaaagctcggcaaagcctgcggaattgaagtgggagcagcagctgttgccattatgttatagcgtactttttgtttttatataagatatcaatcttatgtaaagacattgttttttgcctaatgatgaaccacctgggtatgtgggttataaaacgtaatgaagggaggaacacaacatgcctacaattaatcagctaattcgcaagggacgcgtgagcaaagttgaaaactctaagtcacctgcactaaacaaaggatacaacagctttaaaaaagagcacactaacgtatcttctccacaaaaacgcggggtatgtactcgtgtcggtacaatgacaccgaaaaaaccgaactcagcacttcgtaaatatgctcgtgttcgtttgactaacggaatcgaggttactgcctacattcctggtatcggtcacaacctgcaagagcacagcgttgtactgatccgcggcggacgtgtaaaagacttaccgggggtacgctaccacatcgttcgtggcgcgcttgatactgccggagttgaaaaccgtgcgcaaggccgttctaaatacggtacgaaacgtcctaaagcaaagtaataacaataaatcattaaaactatgaagggaggatattcagatgccacgtaaaggtcctgtagcaaaaagagatgttttacctgatccgctttacaactctaagctggtatcccgcctgatcaacaaaatgatgatcgacggtaaaaaaggtaaatctcaaacaatcctatacaagtcattcgatatcattaaagaacgcactggcaatgatgcaatggaggttttcgaacaagcattgaaaaacatcatgcctgtacttgaagtaaaagcacgccgtgtaggtggagctaactaccaagtgcctgtagaagttcgtcctgaacgccgtacaactcttggtcttcgctggttggttaactatgcgcgtcttcgcggagaaaaaacaatggaagagcgcctggctaacgaaattcttgatgcagctaacaacactggtgctgccgttaagaaacgtgaagacactcacaagatggcagaagcgaacaaagcatttgctcactaccgctggtaggattcatataatcaaaataataattccctaataaggaaggagaaattacccaatggcaagagagttctccttagaaaaaactcgtaatatcgggatcatggctcacatcgatgccggtaaaacgactactacagaacggatcttgttctacacaggccgtatccacaaaattggcgaaactcacgaaggtgcttcgcaaatggactggatggagcaggaacaagaacgcggtatcacaatcacttctgcagcaacgactgcacagtggaaaggttaccgtgtaaacatcatcgatacaccgggacacgtagacttcacagttgaagttgaacgttcactccgtgtacttgatggtgcggttgccgtacttgatgctcaatcaggtgttgagcctcagacagaaacagtatggcgccaagcaacaacttacggagtaccgcgcgttgtatttgtcaacaaaatggacaaaatcggcgcagacttcctttactctgtaggcactttaagagaccgtcttcaagctaacgctcacgcaattcaattgccgatcggtgctgaagacaacttcgaaggtatcatcgacttagtagaaaacgttgcgtatttctacgaagatgaccttggaactcgttcagatgcgaaagaaatccctgaagagtacaaagagcaagctgaagagcttcgcagcagcctgattgaagctgtagctgagcttgatgaagagcttatggaaaagtaccttgaaggtgaagaaatcactatccctgaactgaaagctgctatccgtaaaggtacactgaatgttgaattctaccctgtacttgttggttctgctttcaaaaacaaaggtgttcagcttgtacttgatgctgttcttgactaccttcctgcgccaactgatgttgctgcaatcaaaggtgtacgtcctgatacagatgaagagatcgttcgtcattcttctgatgaagagccgttctctgcacttgcatttaaagttatgactgacccttatgtcggtaagctgacattcttccgcgtatattccggtacacttgattccggttcatatgtaaagaactctacaaaaggcaagcgtgagcgcgtaggacgtatccttcaaatgcacgctaacagccgtgaagagatctctactgtttacgctggagacatcgcagctgctgtaggtctaaaagatacttctactggagatactctatgtgatgaaaaggatcttgtaatccttgaatcaatggaattcccagagcctgttatcgacgtagcgattgagcctaaatcaaaagctgaccaagataaaatgggtatcgctttagcgaaacttgctgaagaagatcctacattccgtacacaaactaaccctgaaacgggtcaaacaatcatctctggtatgggtgagcttcaccttgatatcattgttgatcgtatgaagcgtgagttcaaagttgaagctaacgttggtgctcctcaagttgcgtaccgtgagacattccgtaccggtgcaaaagttgaaggtaaattcgtacgtcaatcaggcggacgcggtcagttcggtcacgtttggatcgaatttgaaccgaacgaagaaggcgctggctttgaattcgaaaacgcaatcgtcggtggtgttgttcctcgtgaatacatcccagccgtacaagcaggtcttgaagactctcttgaaaatggtgtcctagccggattcccgctaatcgacatcaaggcgaaactttttgatggatcttaccatgatgttgactcaaacgaaatggcgtttaaagtcgctgcttctatggcattgaaaaatgcagtcagcaaatgtaacccagttcttcttgaaccaatcatgaaagttgaagttgttattcctgaagaatacatgggggacatcatgggtgatgttacctctcgtcgcggacgcgtagaaggtatggaagctcgcggtaacgctcaagttgtgcgtgcgatggtacctcttgctgaaatgttcggttacgctactgcccttcgttctaacacgcaaggacgcggtacgttcacaatgttcatggatcactacgaagaagtgccgaagagcatcgctgaagaaattatcaaaaaaaataaaggcgaataattgattttgccacttaactcaagtataactactattgtaagatgaggaagtgagagcttgctttcactttctatcactctatacattactaattaaaagctcttaaggaggattttagaatggctaaagaaaaattcgaccgttccaaatcacatgccaatatcggtacaattggacacgttgaccatggtaaaacaacattaactgctgctatctcaacagtacttcataagaaatctggtaaaggtacagctatggcgtacgatcaaattgatggtgctccagaagaacgtgagcgcggtatcacaatctctactgcacacgttgagtacgaaactgacactcgtcactatgcacacgttgactgcccaggacacgctgactatgttaaaaacatgatcactggtgctgcgcaaatggatggagctatccttgtagtatctgctgctgatggcccaatgccacaaactcgtgagcacatccttctttctaaaaacgttggtgtaccatacatcgtagtattccttaacaaatgcgacatggtagacgacgaagagcttcttgagcttgttgaaatggaagttcgcgatcttcttagcgaatacgacttccctggtgatgatgtaccagttgttaaaggttctgctcttaaagctcttgaaggcgatgctgagtacgaagaaaaaattcttgaacttatggctgcagttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagaaaacagcaaaacaactgttacaggtgttgaaatgttccgtaagcttcttgactacgctgaagctggagacaacatcggtgcacttcttcgcggtgtagctcgtgaagatatccaacgtggacaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatcaatcttccagaaggcgtagaaatggttatgcctggagataacactgaaatgatcgttgaacttatctctacaatcgctatcgaagaaggaactcgtttctctattcgtgaaggcggacgtacagttggttcaggcgttgtttctacaatcactgagtaatcgactcgttcaataatgcggggtcccttatggggcctcgtttttttgtttccctgctgattccatgtataatagaacgtatacaaattttaggagcagaccgatgaacgataacttcaagaaaaccaatcgtatttcaatgcttcagcaattgcagattaatggcagtgaacaaaccattatgattaatggtgatgacaggagtagtccgctgcttttgtttttgcatggcggtcccggcacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccattcatctgaccgaacgcttatgcaagcaattcagcaggagaaaaatatatatcgccggctattcgtggggttcagttttggcgcttcaagttcttcaagagaaatctgatttgtattatgcgtatatcggtatcagtcaggtggttaatattcaaaaggaagaaacggaagcctaccggctgatgatggaatggagcaggcaacacaaacatatcctgctgggcaagacgctgagctttatcggagcacctccatgggagaaacagctgcagcgaacgctgtttctgctttgtattgaaatgaggggagggggctttacccatcatccgatcggcgctcttaaagcaggggggcgaatgctgtttggtgaaccgtacggtgtgagagggagcttcttagccgcgcggggacaaatgttcagcctgaaacacctgtgggaggatctcatttcctttgatgcaggggaatcagtttcttctattgtaataccgtgctgttttatgtcagggagatacgatttgacggttccggggacgacgtcttatgaatattatcagaaggttgatgcgccgtataaagaatggcattggtttgagaactcagcccattcgcctcacttggaggaaccggatcgctttgccgaagttgtcagccggttcgcatcgttccatctctgaaagaaaacagtcatatccttgattaatcatggtatcacctgtataataatcaaagtgtgaaaaccacaaggttctttaaataaaccttgcaacatgcgtctattttctgtataatagtgtatgttggtctttgactgcgatgaagtgagaggttgctgacacacccggccgctttgccatggcaaggtgatcaggtttttctcacggagaactgtctaacgtgatgtaggcgaaaaggagggaaaataatggcaaaacaaaaaattcgtattcgtttaaaagcatatgatcatagaatccttgatcaatctgcagagaagattgttgaaacggcaaaacgttctggtgccagcgtatctggtccgattccgttgccgactgaaaaatcagtttacacaatccttcgtgcggtgcacaaatacaaagattctcgtgagcaatttgaaatgcgtacacataaacgtttaatcgacattgtgaacccaacaccacaaactgttgatgctctcatgcgattagacttaccatctggtgtcgatatcgaaatcaaactttaattctaaaatatagaatgatcttaataggaggtgtgacgaatgaccaaaggaatcttaggaagaaaaattggtatgacgcaagtattcgcagagaacggtgatcttatcccggtaactgttattgaagcagctccaaacgttgttcttcaaaagaaaacagctgaaaatgatggctatgaagcgatccagcttggttttgacgataagcgcgaaaagctttcaaacaaaccggaaaaaggacacgttgcaaaagcggaaactgctcctaagcgcttcgttaaagaattacgcggcgtggatatggatgcgtatgaaattggtcaggaagtcaaggttgaaattttctctgcaggagaaatcgtagatgtaacaggagtatctaaaggtaaaggtttccaaggtgcaatcaagcgccacggacaatctcgcggacctatgtctcacggttcacgctaccaccgtcgtcctggttcaatgggacctgtagatcctaaccgtgtattcaaaggtaaactattacctggacgcatgggcggagatcaaatcactgtccaaaaccttgaagtcgtaaaagtagatgctgagcgcaatcttcttttgattaaaggtaacgtacctggtgcgagaaaagctttaatcactgttaaaagtgctgttaaatctaaataagtctcttaggaaaggaggaaattgatcatgccaaaagtagcattatacaaccaaaacggttctactgctggtgatatcgaattaaacgcttctgtatttggaattgagccaaatgagagcgtagtattcgacgctattcttatgcaaagagcttccttacgtcaaggatctcacaaagtaaaaaatcgttctgaagtacgcggcggaggtcgcaaaccatggcgtcaaaaaggtacaggtcgtgcccgtcaaggttcaatccgttcaccacaatggcgcggaggtggtgtcgtattcggcccaacaccacgcagctattcttacaaattacctaaaaaagttcgccgcttggcaatcaaatcagtattgtcttctaaagtgaacgacaacaacattattgttcttgaagatcttactcttgatacggttaaaacaaaagaaatggcagctgtccttaaaggattatctgttgagaaaaaagctttaatcgtaactgcggatgcaaacgaagcagtatctctttctgcacgcaacatccctggagttacagttgttcaagctaacggaatcaacgtgttagacgttgtcaaccacgagaagcttctgattacaaaagctgcggttgaaaaagtagaggaggtgcttgcataatgaaagatcctcgtgatgttcttaagcgccccgtcattactgaacgttctgctgatttaatgactgaaaagaaatatacttttgaagttgatgtaagagctaataaaacagaagtgaaagatgcagttgaaagtatctttggagtgaaagttgacaaagtcaacatcatgaactacaaagggaaatcaaaacgtgtcggccgctatactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaacggacgtcgtggcatgacaacttcagattttgctgaaatcacgactgaccagccggaaaaatccttgcttgcgccccttcacaaaaaaggcggacgtaacaatcaaggtaaattgactgtacgtcaccaaggtggcggacacaaacgccaataccgtgttatcgacttcaaacgcgataaagatggtatacctggacgcgttgctacagttgagtacgatccaaaccgttcagctaacattgcactaatcaactatgtagacggagaaaaacgttacattcttgcaccaaaaggaattcaagtaggtactgaaatcatgtccggccctgaagctgacatcaaagtaggtaacgcacttccgcttatcaacatccctgttggtacagttgtgcataacattgaattaaaacctggtaaaggcggacagcttgtacgttcagctggtacatctgctcaggttcttggtaaagaaggcaaatacgttcttgtccgtcttaactctggtgaagttcgcatgatcctttctgcttgccgcgcttctatcggtcaagtaggtaacgagcagcacgaacttatcaacgttggtaaagcaggacgctctcgctggaaaggcatccgccctacagtccgcggttctgtaatgaaccctaacgatcacccgcacggtggtggtgaaggtcgcgcgccaatcggacgtaaatcaccaatgtctccttggggcaaaccgactcttggattcaagacacgtaagaaaaagaacaaatctgataaatttatcgtacgtcgtcgtaaaaataaataacggggttgtctacggttcatttcggaccgtagtgcaatcacgaagggaggttccaaaatggctcgcagcttgaaaaaaggaccatttgtcgatggacacttgatgacaaaaatcgagaaattaaatgaaacggacaagaaacaagttgtaaaaacttggtctcgccgttcaactattttcccacaatttatcggtcacactatcgcagtatatgacggacgtaaacacgtgcctgtattcatttctgaagacatggtaggccacaagttgggcgaattcgcaccgactcgtacttacaaaggccacgccagtgacgataaaaaaacaagacgctaagagaggaggcttttaaatgcaagctaaagctgttgcaagaacagtccgtattgctcctcgtaaagcacgtctagtaatggacctgattcgaggtaagcaagtaggcgaagcagtatctatcttgaacctaactccgagagctgcttctccgatcatcgaaaaagttttaaaatctgctatcgcaaatgctgagcacaactacgagatggacgctaacaatctggttatttctcaggcatttgttgacgaaggcccaacgttaaaaagattccgcccgcgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaattcattagcaaacgcctttctgacgcttctgtttctaaagtagaaatcgagcgtgcagcaaaccgcgttaacattacgatccacactgctaagcctggtatggtaatcggtaaaggcggatctgaagttgaagcacttcgtaaagcccttaacagccttactggcaagcgtgtacacattaacattcttgaaatcaaaagagcagatcttgatgctcagcttgtagctgacaacatcgctcgtcaactagaaaaccgtatttctttccgccgtgcgcagaaacaacaaatccaacgcactatgcgtgctggagcacaaggtgtgaaaacaatggtttccggccgtcttggcggagctgatatcgctcgttctgaatactacagtgaaggaactgttccattgcacactttacgtgctgacatcgactatgcaacatctgaagctgacacaacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgcggtcgcgctaaaggcggtactgaagtacattttggtgagtacggtatccaggctcttgaagcttcttggatcacgaaccgccaaatcgaagctgcacgtattgcgatgactcgttacatgaaacgtggcggtaaagtttggattaaaattttcccttcaaaaccttacactgctaaaccgcttgaggtacggatgggttccggtaaaggggctcctgaaggctgggtagctgttgtaaaaccgggcaaagttttatttgaaatttctggtgtgtctgaagaggtagctcgtgaagctcttcgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgccaacaaataatcactgaggggaggtcgtgagcatgagcgaacgtaaccaacgcaaagtttaccaaggccgtgttgtttctgacaaaatggataaaaccatcactgttgttgttgaaacatacaaaaaggatcctatttacggtaaacgcgtaaaatactcaaagaaattcaaagcacatgatgaaaataaccaagctaaaatcggagacatcgtaaagatcatggaaactcgtccattatctgcaactaagcgttttcgtctagtagaagttgtcgaagaagctgttattatctaataaagttcggaattctttttccgaagggaggtaacaaataatgattcaacaagagactcgtttaaaagttgctgacaactccggtgcgcgtgaggtacttactattaaagttcttggcggttctggacgtaaaacggctaacattggtgatgtaattgtttgcacggttaaacaagcaacaccaggaggcgttgtcaaaaaaggtgaagtcgtaagagctgttatcgttcgcacaaaaagcggagcacgcagatctgacggatcatacatcagcttcgatgagaatgcatgtgttatcatccgtgacgacaagagcccgcgtggaactcgtatcttcggaccggttgcccgtgaattacgtgaaaacaacttcatgaaaattgtttctctggctccagaagttatctaatgaaataaatgccttactcaaggaggtgcgatcaggatgcatgtgaaaaaaggcgataaagtaatggttatctctggtaaagataaaggcaaacaaggtacgatccttgctgctttccctaaaaaggaccgcgttctagttgagggcgtaaacatggtgaagaagcactctaaaccaactcaagcaaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgttgcaaaaaaatctgggcaagtcttagataaatagtatttaaaggaagggaggtctatctcatgaaccgccttaaagaaaagtacaataaagaaatttcacctgctttaatgacgaagttcaactacgactctgttatgcaggtgccaaaaatcgaaaaaatcgtaatcaacatgggtgtcggtgatgctgttcaaaacgcaaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcgggatttctaagaaatctttcgacggtcgcggaaactacactcttggtatcaaagaacagttaatcttccctgaaattgactacgataaagtaacaaaggttcgcggaatggacatcgttatcgtaacgactgctaactctgacgaagaggctcgtgagctattaactcaagtaggtatgccgttccagaaataatcaatgaaagggaggcgaaatcgtggctaaaaagtcaatgattgcgaaacaacaacgtacaccaaagtttaaagtgcaagagtacactcgctgtgaacgctgcggacgtccgcactcagtcattcgtaaatttaaactttgccgtatttgtttccgtgagcttgcatataaaggacaaattcctggcgtgaaaaaagccagctggtaatccccaagaatgggaaggaggtaattatataatggttatgacagatccaattgcagatatgctgactcgtattcgcaatgcaaacatggtacgtcatgagaagcttgaaattcctgcttctaaattgaaaagagaaattgctgacattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaaaccaggtttgcgtgtatacgctaaatcaaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacaagaatggaggtgttttagtatgtctcgtgtaggtaaaaaactgcttgagatcccttctggagttacagtaacgctgaacgaaggcaacactgtagctgtaaaaggaccaaaaggagaattaactcgtactttccatcctgatatggaaatcaaaattgaggacaacgtgcttacagttactcgtccttctgatcacaaagagcaccgtgcgctgcatggtacgactcgcagtctgcttggaaacatggttgaaggcgtatctaaaggatttgaaagaggtttggaattagtcggtgtcggttatcgtgcggctaaatccggaaacaaacttgttttaaacgttggatactctcaccctgttgagatcgttcctgaagagggcatcgaaatcgaagttccttctcaaactaaagtagttgtaaaaggtacagacaaagagcgtgtaggagctatcgctgctaacatccgcgctgtacgttccccagagccttacaaaggtaaaggaatccgctacgaaggtgaagttgttcgccgtaaagaaggtaaatctgctaagtaagaccgcttaaagtgaagaaaggagtgacctaaggatgattacgaaaactagcaaaaatgctgctcgtcaaaaaagacatgcccgtgttcgtgctaaactttcaggcacagctgaaagacctcgtctgaatgtgttccgttcaaacaaacacatttatgctcaaatcatcgatgatgtaaatggcgttacacttgctagtgcctctactctcgataaagatttgaacgtggaaagcactggtgacagcgctgctgctgctaaagtcggtgaactcgttgcgaaacgcgcttctgagaaaggtgtttctgacgtagtatttgaccgcggcggatacttataccatggacgtgtaaaagctctggccgatgcagctcgtgaagccggactgaaattttaataaaaaaaggagggacacatgattatgcgtcgtattgacccaagcaaattagagttagaagaacgcttagttacggttaaccgcgtagcgaaagttgttaaaggtggtcgtcgtttccgtttcgcagctctagtcgttgtcggtgacaaaaacggtcacgtaggtttcggtactggtaaagcacaagaagtacctgaagcaatccgcaaagctgttgaagatgcgaaaaagaatttgattgaagtaccaatggttggaactacgattccacacgaaatcatcggacgtttcggtgcaggcaatatcttgttgaaacctgcttctgaaggtactggagttatcgctggaggccctgtacgtgcggtacttgagcttgctggcgttgctgatatcctttctaagtctttaggttctaacacaccgatcaacatgatccgtgcaacacttcaaggtttaagtgagcttaaacgtgccgaagaggttgcgaagcttcgtggaaaatctgtagaagaactgttaggataaggagggaacattaatggctaaattagaaattaccctcaaacgcagtgtaatcggtcgcccggaagatcagcgcgttactgtaagaacacttggtttaaagaaaacaaaccaaactgtcgttcatgaagataacgctgcgatccgcggtatgattaataaagtatctcatctagtttctgttaaagaacaataaaaataaattataggctaaggaggtgtcctaatgaaacttcatgaattaaagccttcagaaggttcacgtaaagtacgcaatcgcgtaggtcgtggtattggttctggtaacggtaaaacagctggtaaaggtcacaaaggtcaaaacgctcgttctggcggcggtgtacgccctggattcgaggggggacaaatgcctttattccaacgtcttcctaagcgcggttttacaaacatcaaccgtaaggaatacgctattgtgaacgtagacaaattgaacggttttgcggaaggaacggaagtcactcctgaacttcttcttgagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaagacaatctccaactttatgcgtgtgagtgatattcggaataaaatcatttttacattactcatgcttatcgtctttcgcataggtgcgtttatccctgtgccatatgtaaatgctcaggcgttgcagacacaaagttcgatgggggtttttgatctccttaacacatttggcggcggtgcgctttatcagttctccatttttgcgatgggaattacgccttacatcactgcttcgatcatcattcagctgcttcagatggatgttgtgccgaagtttaccgagtggtctaagcaaggtgaagtcggccgccgtaaattagctcagttcacgagatattttacgattgtgcttggttttatccaggcattaggtatgtcttacgggtttaacaacctggcaaacggtatgctgattgaaaaatccggcatatcgacatatctgattattgctttagtactcactggaggaactgcttttttaatgtggctgggtgaacaaattacttccaatggagtaggtaacggaatttcgatcatcatcttcgcggggattgtggctagtattccgaaaactgttgggcagatttatgagactcaatttgtcggcagcagcgatcagctgtttattcatattgtgaaaatcgctttactggtgattgcgattttggccgttattgttggtgttattttcattcagcaggccgtacgcaaaatcgcgattcaatatgcaaaagggcaaggtcgttcacctgttggcggaggccagtcaactcaccttccgcttaaagtgaatccggcaggggttattccggtaatctttgcggttgcgttccttattacgccgcgtactatcgcgtcatttttcggagaaaacgatgtgacaaagtggattcaagccaactttgacaatacacatccggtgggcatgacggtttatgtcgcattaattatcgcctttacgtacttctatgcttttgtgcaggtaaaccctgaacaaatggctgataacctaaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacagattggcggaacatcattgttaattgtcgtcggggtagccttggagacaatgaagcagctggagagccagttagtgaaacgtaattaccgaggatttatgaaaaattagaggactggttttaaccattcctctaaataagagaggacgggggaaatccgaatgaacttagtcttaatgggacttcctggagccggtaaaggcacacagggagaacgaattgttgaggattatgggatacctcatatctcaacgggagatatgttccgtgctgctatgaaagaagaaacaccactcggactcgaagcaaagtcttatattgataaaggcgagctcgtaccggacgaagtcacaatcggcattgtcaaagaaagactcggcaaagatgattgtgaaagaggttttcttctggacggatttccgcgaacagtcgctcaggctgaagctcttgaaaacattcttgaggaatacggcaagccgattgattatgtcattaacattaaagtagacaaagactctttaatggaacgtttgactggacgcagaatttgcagtgtttgcggcacaacctaccatttggttttcaatccgccgaaaacgccgggtgtttgtgataaagacggaggagacctttatcaacgggcagatgataatgaggaaaccgtctcaaaacggcttgaggtcaacatgaagcagactcagcctttactcgatttttattctgagaaagggtatcttgtcaacgtcaatggccagcaggacattaacgacgtgtacaaagatgtgaaagagcttcttggaggattgagcaaatgattatctgtaagacccctcgtgagcttagcatcatgcgggaagcagggcgaatcgtggctttgactcatgaagagatgaaaaagcacattaaaccaggaatctcgacaaaagaattggatcaaattgccgaacgttttattgagaagcagggtgcaatcccatcttttaaggggtataatgggtttcgcgggagcatctgtgtatcagttaatgaagaactcgttcacggaattcccggtaaaagggttttgcgtgacggtgacattatcagcattgatatcggtgctaaattaaatggttatcatggtgactctgcttggacatatccggtaggaaacatcagtgatgatgataaacgactgctggaagtgacagaggagtctttatataaaggcttgaaggaagcaaaaccaggtgaacgtttgtcgaatatttcccacgcaatacaaacgtatgtcgaaaatgagcagttttcagttgttagggagtatgtcggacatggtgttggtcaagacttgcatgaggatccgcaaattcctcattacggtccgccaaacaaaggacctaggctgaagcctggtatggttctcgctatagaaccgatggttaacgctggcagccggtatgtgaaaacattggctgataactggacggttgtaacggtagatgggaaaaagtgtgctcattttgaacatacgattgcgattacggaaacgggttttgatatactgacaaaagtctagatgatgaaatgaattccatgacacatgtttttcattccgcacctgggcagattgtaggtttacaattggtcggaagaaaaaccggctagctgctgtcatcggaaggaagattcatcatcgtgtactaaagcagacggagaaaagcgtacatttcattctccttagaaaaagaatatcaatcattcaccctttatgattgcgtatctccggaagttcagaacagtataaacgaaacagggcgtgtgacaaacggataactgagattttctcttttgaaatttgtcagagagcaagttactgatttgaagaagggagaacacttgaatggcgaaagacgatgtaattgaagtggaaggtacgattgtcgaaacactgccaaacgcgatgttcaaagttgaactcgaaaatggccatacggttttggctcacgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgagaaatgtaaagttattcgcagaaaaggaaaagtaatggtgatctgtgaaaatccaaagcataaacaaaaacaaggataattaataaggaggtgcccagagaatggctcgtattgctggtgtagatatcccacgtgacaaacgtgttgttatttctttaacatatgtcttcggaattggccgcacaacggctcagcaagtcttgaaagaggctggtgtttctgaagatactcgtgtgcgtgatcttactgaagaagaacttggtaaaatccgtgatgttattgacaaactgaaagtagaaggtgaccttcgccgtgaagtttctcttaacatcaagcgtctgatcgaaatcggaagctaccgcggaatccgccatcgcagaggtttgcctgttcgcggacaaaactctaaaaacaatgcgcgtactcgtaaaggtccgcgtcgtactgtagctaacaagaaaaaataagtaagggaggtacctaaacaatggctgctgctcgtaaacaaaacacgcgtaaacgtcgcgtgaaaaagaatattgagtcaggaatcgctcatattcgttcaactttcaacaacacgatcgttacgatcactgatactcatggtaatgctatttcttggtcaagtgccggagctctaggattcagaggttctcgtaaatcgactccttttgctgcgcaaatggctgctgaaacagctgctaaaggttcaatcgaacacggacttaaaactcttgaagtaactgttaaaggaccaggttctggccgtgaagctgcaatccgtgctttacaagctgccggacttgaagttacagctatcagagacgtaactcctgttcctcataatggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccgcttgagcgtggatatggtacaactctgggtaactccttacgtcgtatcctcttatcctcactccctggtgccgctgtaacatcgatccagatagatggtgtactgcacgaattctcgacaatcgaaggcgttgtggaagatgttacaacgataatcttgcacattaaaaagcttgcattgaaaatctactctgatgaagagaagacgcttgaaattgatgtacagggcgaaggaactgtcacagcagctgatattacacacgacagcgatgttgaaatccttaatccggatcttcatatcgcgactcttggtgagaatgcgagtttccgagttcgccttaccgcacaaagaggacgtgggtatacacctgctgattcgaacaaaagagacgatcagccaatcggcgtgattccgatcgattcaatctttacgccagtttctcgtttatcttatcaggtagaaaacactcgtgtaggccaggttgcaaactatgacaaacttacacttgatgtttggactgacggaagcactggaccgaaggaagcaattgctctcggttcaaagattttaactgaacaccttaatatattcgtcggtttaactgacgaagctcagcatgctgaaatcatggttgaaaaagaagaggatcaaaaagaaaaagttcttgaaatgacgattgaggaacttgatctttctgtccgttcttacaactgcttgaagcgtgcgggcattaacacggttcaagaacttgcgaacaagacggaagaagatatgatgaaagttcgcaacctgggacgcaaatcacttgaagaagtgaaagcgaaacttgaagaacttggactcggccttcgcaaagacgattgatctagtttccatgtgaactaggattttcgtgtgttttttaattagaaacagcattccattaaaggaggggacatcacatgtcatacagaaaactaggacgtacgagttcacagcgtaaagctatgcttcgtgatcttacaacagatttgatcatcaacgaaagaattgaaacaactgaaacacgtgcgaaagaacttcgctctgttgttgaaaagatgatcactcttggtaagcgcggtgacttgcatgctcgtcgtcaagctgctgcatacattcgcaacgaggttgctaatgaagaaaataaccaagatgcacttcaaaaattattctctgacattgcaactcgttacgaggagcgccaaggcggatacacacgtattatgaagcttggtcctcgccgtggtgacggtgcaccaatggcaatcatcgaattggtttaatcacatatttttgtgtatctaaagaagggcgggacagtttctaactggatctatgccctttttttagatatcagaactttttatcatgagacagaaaagcagagctatagctgagaggaggtcaggcgcccgtggatcaaaaacagcttatatccgtaaaagacattctattccgctaccgcaaagatgcagaaagaccggcgctggacggtgtgagtctggaggtatatgaaggagaatggcttgctatcgtaggtcacaacggttcagggaagtcgactttggccagagcgctgaacgggctgattttgcctgaggccggagaaattgaagtcggcggcatcaagctgactgaggataccgtgtgggatgtgcgaaaaaaaatagggatggtctttcagaatcccgataaccaatttgtcggaacgactgttcgcgatgatgtggcttttggtttagaaaacaatggtgttccgcgcgaagaaatgattgagagagtagattgggctgtcacacaagtcaatatgcaggattttcttgatcaagagccgcaccatctctccggaggtcaaaaacaaagagtggcgatcgcgggaattattgccgcgcgtcctgatattatgattttggatgaagcgacatccatgcttgacccgattgggagagaagaagtccttgatactgtcagacgcttaaaagatcagggcatggccaccgtcatttcgataacacatgacctggaagaagccgcaagggcggataggatcattgtgatgaacggcggcaggaaatatgcagagggcacgcctgaagagatttttaaattaaatgaagacttggttcgcatcggtcttgatttgcctttctcattccagctcagcctgcttttgaaagaaagcggactggcgttaacgaaaaaccatctgactcaggaagggctggtgaatgagctgtggacattaaaatcaaagatgtagaacaccgctatcaaatgaagacaccgtttgaacggcttgctttgtatgatatcaatgccgtgataaaagagggcggctacgttgccgtcatcgggcatacagggtcgggcaaatcgacgctcctgcagcatttaaacggtttgctgaaaccgactaaaggacagcttgagctcgggagcacgattctggcagccggtaaaaagaataaagaccttaagactctgcgaaaaaaagtcggaatcgttttccaatttcccgaacatcagctgtttgaagagactgtgctgaaggatatcgcattcggaccgatgaatttcggtgtaaaaaaagaagacgctgaacggaaagcaaaagaaatgctggggcttgtgggccttccggaagacattttggatcgttcaccgtttgagctcagcggcggccagatgcgcagagtggcgattgccggcgttctcgcgatggagccggaagtgctggttttggatgaaccgacagccggtcttgatccgagagggcgccaggacattatggacatgttctatgcgcttcatcagcggggaaacctgactaccgttctcgtcacccacagcatggaggacgccgcccgctatgctgacgaaatgatcgtcatgcacaaaggcaccattaaagcgacggggagtccgcgtgacttgtttgtaaaaggtgaagagatggccgaaatgggactggatcttcctgagtcggtgaagtttcagagacggcttgaggaggctctcggagttaagtatgaaaaacccatgctgaccctgcaggatgccgcgagcgaaattaaggctttctttcaggaggaaaaggaccaatgatggacagcatgattatcggaaagtatgttcccggatcatcgcttattcaccgattggacccgcgaacaaaacttgtcagcatctttctttttgtatgtatcgtttttttggcaaacaacgtacaaacgtatgctttgctcggtttgtttacattcggggtgatcgccttaacacgagtgccgttcagctttttgctgaaagggcttaagccgattatctggattgtggcgtttacctttttattacacattttcatgacgcatgaaggatctgtcatttttcagcttggctggtttaaagtgtatgagggcggacttatacaggggatttttatctccctccgtttcgtttaccttatctttatgacaacgctgctgacgctgacaacaacgccgattgaaataacggatggaatggagcagctcttgaatccttttaaaaaggtgaagctgcccgtacacgaactcgcattgatgatgtcgatatcattgcgatttatcccgacattgatggaagagacagataaaatcatgaaggcgcaaatggcgaggggtgcggactttacaagcggcccggtgaaagacagaatcaaagcggttgttccgctgcttgtcccgctgtttgtcagcgcctttaaacgcgcggaagagcttgcggtcgccatggaggcgagaggctaccagggcggtgaggggagaacgaaatacagaaagctcgtctggaccggaaaggataccggagccattctgctcatcatcgtattagccgtgttattgtttttcttaagaagttagaggtgctgctgaatgagagtgaaatgtaccattgcttatgacgggcatttatttaacggatatcaggttcagcctggaaagcggaccgttcaaagtgaattggaaaaagcgctggccgtcatccataaaacggacggcagggtgcctgtcatctcatccggccgcacggacagcgatgttcatgctgccgggcaggttattcattttgatacgccgctgtccatcccggctgagaaatggccgtttgcgctcaatgccctgctgcctgatgatattgccgtcaaaacagcagagattgcggatgatgggttccatgcacgatttagcgcagtccaaaaggaatatcgctactttgtatatacggagaaacacccggacgtatttaaacgacattacgcttaccattttgcatatcagcttaatgtgcagaaaatgagggaagcttcaaggcacctcatcgggacacatgatttcacaagcttttgcgcggctgataccgcggttcaggataaggtcagaacgatttacgagctggattggactgagaccggagacggcctgcagatgcggatcaccggaaacggttttctctataatatggtcagaatcattgccggaacgttattggatacaggagctggaaaattttctcccgatgatgtaaaagcaatgctcgaagcgaaggatcgcgaagccgcggggcgcaccgcaccggggcacgggctgtatttatggagcgtttgctatgacaactaaaccaggtgtaacattttcttgacagagtctgcataaagttataagatatcatatggtatgtatttcaaccccacgataagccccggaacttattgtgttgtgaaatagaacgtaacagaagtttatgaaaaaatgacagatcatttaggagggaattaaatgcgtacaacacctatggctaacgcaagtactattgaacgcaagtggttagttgttgatgcagcaggcaagactttaggacgtctttctacagaagttgcatctatccttcgcgggaaacacaaaccgacttacacaccgcacgttgatactggagatcatgtgatcatcatcaacgctgaaaaaatcgagttaactggtaaaaagttaactgataaaatctactaccgtcacacaatgcacccaggcggtctgaaatcaagaacagctcttgaaatgcgtacaaactaccctgagaaaatgcttgagcttgctatcaaaggcatgcttccaaaaggttctctaggtcgtcaaatgttcaagaaattgaacgtataccgtggttctgagcatccacatgaagcacaaaaacctgaagtttacgaacttcgcggttaattaaaaaggaggttaccaatttggcacaggttcaatattacggtactggccgtcgtaaaagttctgtagcgcgtgtgcgcttagttccaggagaaggtcgtatcgtcgttaataatcgtgaaatcagcgagcacattccatctccggctctaatcgaagatatcaaacaaccattaactttaactgaaacagctggtacttatgatgttttagtaaacgtacatggaggcggcttatctggtcaagctggagcaatccgtcacggtatcgctcgtgctttgcttgaagcagatccagaataccgcgcaacacttaaacgtgctggtcttctgactcgtgacgcccgtatgaaagaacgtaaaaaatacggtcttaaaggcgctcgtcgtgcacctcagttctcaaaacgttaatcgttttggatggcaaaaaccacaacttcttggttgtggtttttttgtatttttttctcatatcgaagaggttatccgatgtttttctagaattgtttgttatactctattcattaccaataaggagcgcagttataatgaataagttagtcatacataacagcaaggcatgggataaaaaagtcgaaacaggcaatgaatggacggttgcggttgattctcatacaattggtgaagcgaaaaaaggcaattggagcatcagaatgacccccggaaaagatgtgccggcggattggtttccgcccatagacggtctgaaggttctttgtctcgcttcaggaggaggacagcaagggccggtccttgctgctgcaggagcggacgtcaccatctttgacaattcggaaaaacagcttgcgcaagacagaatggtagccgagcgggacggtcttacgcttcggactgtcaaaggcagcatgaatgatctgagctgttttgatgatgagtcatttgattttatcgtgcacccggtatcgaattgctttgttgatacggttcttccggtatggaaagaagctcatcgcgtattgaaaaaaggcgggtctttagtctccggttttgtaaatcccgtcgtgttcttatttgatatggatttagagcaggaaggcgtactaaaagtaaagtattccattccgttttcggatgaaaaagatctgagtaagaaaaaggtaaaggaacttattgataatcatgaagcgcttgaattcggccatacgctggaggatcaaattaaaggtcagattgacgcaggctttatggttgccggtttttacgaggacaaaggcggcctcgtgctggatgaatacattaatacatactccgtaacaagaagcattaaaatataaaaacggcatcccgtcagaggtgctgtttttttgcggctttttcctgcggacggctgatcacattagccgaaaccggttctattccaatctctctggcccaaaccgacagttgtcccatgtggtgaatctcatgcgcaaggatgtggcggagaatatcttctttaggaaaggtttggtccatccagtccggcttaacaagatccgcccctttgcgggagaccgcatgaatgacatcctcccgatactgttcagacagctttctgagatcctgaatgctcgtatagtcagactcagcgggtaaaacatcatctttacctaaaatggcacgagcccagctgatctcgacatcaatgatatgaaataaagtccgcaagatgctctccattccgcccgtccgggttttcgtcagttcctcccggctcagcttttcacatatcataaaccactcgtcacgcaccgtccaattgtattgaaacagctttttcatcacgtcacctcagctctttattcttccagttaacatgaaactccttcatttgggaggatttccactatcaacaaagcatgctttttcccttttcctttcaaaataacagtaaaaaggagcgtggctggcaatggcagaagtattatctttttcagacgtgaaaaggcagaaggattatgagcttgagaagagtttactaaaggaactgtcactgacgcagatcattcagtccgtaaaagcatgtctcacccctttgtttccctttcttcaagacgaaaacggcattctgagtgaaggatgcatagattttgcaattgaagcgtatttattaggcggccggttcggcgtctttggctattatggtgagtctttgcagagggcaaacgcccgttcggctgaagaagaggaagaattgacggccgatttttttgaatatctttgcaattggacgcatgagcaatattcttccgttgaacaaaaagaaatctatgaagcgtcctgccggtttatcaacagctggtggacggaaggatttctgcaaagagaaaaacaatgtaagctccgcatgaggtaatcataatttcttcccttgtcccatacttattaataacggggacaagcgggagggaaagctatgacaaaaaagctgaaatggctcggttttttacttggctttatcatattattgtgtttattccggtttcaattccataatgatgattcatggcggccgtggagcctgccgctgagcgggaaaatcatctatctcgatccgggacacggcgggccggacggaggcgccacgggaggcagtcaccttgaaaaggacattactctcgaagtggcctccagggtcagagactatttgcaggagcagggagctttggtcattatgacgcgggagacggatactgatttagctcctgaagggacgaaaggctacagcagacgcaaagcggaagatctgagaaagcgcgtggagatcatcaaccgttcagaggcggagctttatatcagcattcatctgaacgccataccgtcaccgagatggagcggcgcccaaagcttctactatggaaaatacgaagagaatgaaaaagtggcaaaatatatacaggacgaattgagaatcaatttggagaatacaacgagaaaggcgaaacggatacacggcatttacttaatgcagaatgtaaccaaaccgggcgccctggtggaaatcggatttctgtccaatcccgcggaagcgaaaaggctcggccagcctcaataccaggacaaaatcgcttcttccgtgtataagggcgtgttgagatattttacagaaaaaggagaccctcccgagtaaggagggtttttcgccgattctacgtttaatatatggtataataccatttgtaaacgaatacacaaagggtgagggttcgatgataagagaagatgaagtaagaaatatagtcggaaacatgcgcgaaccttttcttcatagaccgctgggagaattggatgccattaaagaagtaaaggtcaagccggaaaaacggcatgtcagtgtaaaaattgcattggcaaaaacggggacggctgaacagatgggcattcagcaggaaatcgtatccgttctgaaagaagcgggtgcggaaactgtgggactgcggtttgaagagctgccggaagaaacattggcgaaattcagccggcctgctgctgaaagcgaaaccctgctgaataggaaacatccgccggtctttcttgcggtggcaagcggaaaaggcggtgtcggcaaatcaacggtttccgtcaacctggccatttctcttgcgcggctcggaaaaaaagtcggcttgatcgacgcggatatatacggattcagcgtgccggacatgatgggtattacagttcgcccgacagttgaaggagaaaaactgcttcctgtcgaaagatttggagtaaaggttatgtcgatgggctttttcgtcgaagaaaacgctccggttgtgtggagagggccgatgctgggcaagatgctgaataacttcttccatgaggttgactggggagaggttgactatatcgttctcgacctgccgcccggcacgggtgatgtggcgctcgatgtacacacgatgcttccgagctgcaaagagattatcgtatcaacgccgcaccctacagccgcatttgtagcggcgagagcgggatctatggcgattaagaccgatcatgaagttgtaggggtcattgaaaatatggcttactatgaaagtgcaaaaaccggcgagagagaatatgtgttcggtcaaggcgggggagataagcttgcagaggaattgcaggtgccgctgcttggcagaattcctttaaaacagcctgattgggacaaggaccagtttgcgccttctgtctatgacagaagtcatccgatcggggaaatttatatgggtatcgcccaaaaagtcattgaaaaaacagctgaataaaaaaggggccgggatcaacacggcccggccttttattggctttctttttcagaacttgaagccgcttttttcaattcatcctcgaattgctttttgaaaagcgggctggaaagtgtctctgtaattacatcttctaagtaactgcggaacttttggcttttcaccagctcatagtattttttatccatgccggggtcctgcatgatctgcataaaacttttctgataatcagggtctttcatcagtttttttatgattttttcgtgctcgggctgaagcgtttttgcaaagctctccgcgaactttgagtcttcaaagatggttttccagaactccgccccttttttagaggtgagggttttctctattgtgcctttaatggcattttgatcaatcaccaatgcctcattcatcgcatcatcatttaatatttccttaattgctttttttccatcatctgtctttaatatatcaacaaccatttttttagtctggtcataatccatatccgctgcttggtcttttggagcacaagctgttacagataatacaataaaacagcttatcaatagcgttttggcttttgacatgcataagctccttccttacttgtacttatttttaatatgattcatcggaatggatttatacataacaaaatatcgctgaacgcgattgtcagggggatgaataagagatgaaaagccgcgggcttgttcgatttttcttttcgattttagctgtgggcgctcttattacaagcgtcgtgggatttgcactgaagtggggggagtacaaggggttctttctgaattttgaggccggtcagattttctccgttctgatctggtttatcggggtaggcatgattttcagtgtgatcagccagatgggattcttcgtctttctgacggtgcaccggtttgcccttgaaattctcagatcaaactcgctttggaatctgcttcagctgtttatcattctgtttgtcgcttttgatttaatgtacgtcagatttttgtttttcggtgagcgggatgactcgattgcggggtttgtctggctgccgctggctctgcttgccgtcggcctgttgacggcgtatataaaacaaaagcagtcctcaaaaaatacgttcgtttcatcattatttttaatggtcgttattacagcgcttgaatgggttcctgcgctaagagtgaataatgaggactggctttatttgatgctgattccgctgatgggctgcaatgcgtttcagctgttaatgctgccgaagtttgcccagaggtagttatttcacttctgatgacttgacgtcagtatttgcgatcaggtcgccgactgtcacgtttttcagtcctttttgctttaaattgtgaatgatggcggggagcgcttcttcggtctgtgttgctgaatcagaggcgtgcagcaggacaatgtcgccgccttttatatgactgtttacattttcaatgattttatcaggaccgggatttgtccaatcctgcgagttaacgctgtaatgaaccactgaatagcggtactgctgtgcaatggcaagaacctttttattaaattgtccggtcggcgggcggagtaaatgaacattcttcacacccagctttttaaatgcggtctgggcccgaaggatatcttttcttatttcgttgtcctctaggttggtataattcttatacgcatatcccatgctgccgatttgatgtccgtcttttaccatacgttcaactgtgtccgggtgccgttccgcccaagaagctgacagaaaaaaagtggcgtttttaataccgtttgcttttagcgcgttcagaatcggaaccgctttttcatcgccccagctgatatcgaatgttaatgcgacttcgcccgctttcgtctccccttttgaaatagccttcgggccgctatcagttaaaaatacaggaagggggacggctctctgtatataaaaaaagctggctgctgcaaatgcggcaatgataataataagcagctgttttatccttctgatgtgccacacgtagaagtggttcactgatgacgcctccttatcttgtccatgcttgattacatcgtatgccgcggcggagatgaatataacgaaatacgtttcaaaaaaaacgaaaaaaatacttgctaaattcagcggatgcatggtatattattaaacgtcgc

SEQ ID NO: 126 - DNA, 55119 bp, Bacillus velezensis FL50S
tgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttttgaataaaaacaaaacaaacaccgaaatacgggaacgcccatatactaattgcaaacttcaaaaagatccaaattgtgtatacaatcaacagtttaagggaaggctattcatacggaggtgggcaaaatgaatgaaacgtccggccatgaagaaacatgtattgtgtgtgaaaccaagaaaagcaggggaatccatatttatacgaaatttatatgtttagagtgtgagaagaaagtagtttccactccgacctctgatccgaattatgaatttttcgttcgtaaattgaaaagccttcatacaccgacgttatattcttaaccctgaaaagggtcttttttttgcctgaaatcagaggagttttttcactttttataaaagaactgatacgataagaagaggaacttgtttagacatggaatgtaatagataatactgataaaagtgaataaataggagtcgatcaagtatgaaaccgtttattcaatatatgaaatggacattttgcgggagcacagtttttgtattagcggggataaccttctttacgatagggcatcagccttttctgtattcgcttttatacggggcagccggcggagccgcagtcagtgcgtccggcttgtggaatgcgaagcgtctctttttaaaaaaacaccggctgacaagaaaagaatatgcttatatcaaggaaaatctcgaggaagcaaagggtaaaatcatccgattacgcagggcgcttttccgctcgaaaagtatacaaatgctgaagcagaatgcagagatactgcggataacccgacgaatatatctgctcacaaagcaggagccgaagcgtttttatcaggcagagcgtttctattatcaaacgcttgattctgttgtggaactgacggaaaagtatgctttgctctcatcacagccgcgaaaaaataaagatttatcaatgttcttgagtgagacgaggatgactctggcggagctttccagaaggctggaagaggatcttcatgaactgatgaaggaggacatcgacgacctgcactttgaattagatatggcaaagcattcactgagaaaataagaaaggaagaaggaaatggccaaagaccgttccgatgacagcataggcgcccaaaatgaccagactcatctaaagcttgcagatacgctgccggaagaaaaaagagaagcggcacttcagctcgctgaaaaactggaccctggaaacatgcaaagcattgttctgtttggttcacaggcgcaggcgaatcttctggaattttcccacacgatgatagagcacgtgcaaagaaaagatgcaggagagatgggacaaatattggctgatctgatgctgaagcttgaccaggtaaaccccgatgatctgcaggtaaagaacaaagggtttttcgcccggctgtttaaaagggtatccggatctgtgcaggaagtgctttcgaaatatcaaaagacaagtgtgcagattgaccgtatcagcagaaggctggaacattctaaaaatgtgctgttgagtgacaataaatggttagatcagctgtacgcccaaaataaacaatacttttctgatttaactatgtatatagcagcgggtgaattaaaattagatgagctgaaaacaaagcttattcccgaagcggcaagaaaagccgaattacgagaacacaatcaaatggccgcgcaggaagtgaatgatcttcgccagtttgccgaccgtctggataagagggtgcatgatctgctgctgagcaggcagattacgcttcagagtgcgccgcaaatccgtctgattcaaaacacgaatcaggcactggcagagaaaattcagtcctccattgttacggctattcctttatggaagaatcaagtcgccatcgcgctgacgcttatgaggcagcggagtgcggcagatgtgcagcagaaggcggcggatacgacaaatcaattgctgctgaaaaacgccgaacttctgaaaacaagcacagtcgagacggccaaagccaatgagcgcggacttgttgaggcagacaccctcaaaaaagtgcaggaaagcttagtcagcacacttgaagaaatcatgtctattcaagaagaaggcaggatgaaacgcaggcgtgccgaggaggagcttgttatcatggaaggcgatttaaaaaagaagctgcttgatatgagttccggccgggataacggctagatggcaaaaagtcttagctttaagttggctcgcaggcacgatataataagaaagacaggcaaaggatttgtttaaaaatggacacacctttatatacagcgctgatgaagcatgcgcaccgaaatacgtattcttttcatgttccgggacatcacaatggagatgtcttttttgatgaagcgaaatctgtatatcaatctcttttatctattgatatgactgagatcacgggtcttgatgacttgcatcacccgacaggggtcattaaggaagcgcaggatttggtgagcagattgtatggctctcaggaaagcttctttctcgtcaacggaacgaccgccggcaatctggcgatgattttagctgtttgtgaaccgggtgaacccattctgatccagcgtaattgtcacaagtctgttttccatgcggtggcattggccggagccaagccggtttatttggcgccggaaatcgatgaaaacatgcatgtgccggcacatgtatccctttcagtcatcgaaaaagcgctggcgtcatatccgaacgcgaaaggacttgttttgaccaatccgacttattacggacacgccgccgatttgactgcggcagttaaaaaagcccattcatacggtgttcctgtgctggtggatgaggctcatggagctcactttgtgttagggcagcctttcccgccttcatcattggctatgggggcggacgccgttgttcaatcggctcacaaaacgcttcctgctatgacgatgggatcttactttcatttaaacagcacccgaattgacagagatcgattaacttattatgtaagcagtttgcaaagcagcagcccgtcatacccgattatggcatctttagatacggcgcgtgcttatgtgcaggatattgctgaaaaagggacacttcccgtccatatggagcacattgagaaaatcaaacgaaggttcgcatcaatttcttctattgaaataatcgagccttccggatatgggctgcgggcggacccgttaaaattaatacttcggtcaaagctcggacattccggctattcattacaacgcattttggagagtgagggcattgttgccgagctggctgacgagtaccaagtattgctcgtactgtcgataggcggccggcggatgatagaacaggcagccgtaagaaacatacagcagaaactggagaatacaccgcccgataaattgccggatgccgtgaattggacatttccgtccatttcgacacttgaatatccgcaaaatgagatgcggaagtttacaaaagagcctgcagatataaataaggcggccgggcgcttgcatgcggggaacattattccttatccgccgggaattccgctgatcatggacggcgaacggataacagaagagatcgtacagaagctttcccgtttaatcggcatggacgcgcatattcaaggcttgttaaacggggaacaattacttgtctatatagaagaggagaaatcatgagcggtttatttataacatttgaaggtcctgaaggtgcagggaaaacgactgtgcttcaggaactgaaagagattctgtcggcagaggggctcccggtgacagcgacaagagaaccgggcggcatcgacattgcggaacagatcagagaagtgatcttaaataaaaacaatacactgatggatgcaaaaacggaggcgctgctttacgccgcggcgagaagacagcatttaaccgaaaaggtgcagcctgcattgaaagaagggcgcattgtgctgtgtgatcgtttcatcgacagttcgctggcttatcaaggctatgcgagagggctcggcattgatgaagttctttctatcaaccagtttgcaatcggcgatacgatgcctgatgtcaccatctatttttctattgagcctgaagaagggttgaaacggattacgtcgaatgattcaagagaaaagaatcgtctcgatcttgaggctctgcactttcacacgaaagtacgggaaggataccaaaaggttatgcagcgttttccggaaagattccatacaatcgacgcatcgaaaaagaaggaactcgtcattcaggacgcacttcaagtgataaatgaagcattgaaaaaaattcagttgtgacctgtttctcataagttgctataatgaatgtaacgacaatgttctttccaacctaaagggggcctagagaatgaaattaatagtggcagtggtgcaggatcaggacagcaacaggcttttgaaagtattaaccgaccacaacttcagggtgacgaagcttgcgacaacaggcggattccttaaatcaggcaatacgacgtttatgatcggggtggaagatatccgtgtcgataaagcgctcagcctcattaaagagaatggctgtaaacgtgatcagatgattgccccggtatccccgatgggcgggaatgcggattcctacgttccatatcccgtcgaagtggaagtcggcggagcgacggtctttgtcctcccggtcgatgaatttcatcaattttaaggatttgacgacgtgaaaataaattctgacttacgtacatttattgagaaaaagcagcagcctgcttataaagcggcagagctttccggaacgtttaaaagttcaatggacagccaaagcagcaagctgaaatttgatcagctgagcaggttcttaacggatatagaaacgttcgggaaaaggctgacgaagtcgagaaacttcaaagacttagcgaagttcaaaggattggtaaaacgttttgtaaaagaggccgtagacagcggattatcgcatgagacggagaaaagctttgacctgtacggcagcagccggaccctggggcttgtgaaagaaatagatgaaaaactgcttcagctgacggaagaaatgttagatcaggaaaaaccggcaattgatttgctggatcgaatcggagaaataaaaggtttattgattaacctttacacatagagagtgatacaatggcaatatcatggaaggaaatgaccgggcagcagcccagagtgatgcggcttttgcataacagcattgaaaagaaaaggctttctcacgcatatctgtttgaaggcaaaaaaggtacgggcaaattggatgccgcactgcttctcgcaaaaagctttttctgccttgaagacgggactgagccttgcggagagtgccggaactgtaagcgtatcgaatccggaaaccatcccgacctgcatgtggttcagcccgacggattatccattaaaaaggctcagatccaatcgcttcaggaagagttttccaaaacggggctggaatcgcataaaaagctgtacattatatcccatgcggatcaaatgacgacaaatgcggcaaacagtctgctgaagtttttagaggagccgagtcaagacaccatcgcaattctgattactgagcagctccaccgaatactggataccatcgtttcgagatgtcaggttctcccgttccagccgcttcagccgaaagccatagaagaaagactgattgaacaggaagtgagccctcacatggcccggctcttagcaaatatgacaaataatattgcggaagcagtcgaattaagtcgaaatgatgagtttgcagagtccagagcgaaagtgataaaattgtatgaagtcttacatcagcggaaaggacatgcctttttcttcattcaggatcagtgggtgccctttttcaaagaaaaaacccatcaagaaatgggtcttgatatgctcttattgatataccgtgatgtattatccatccaaattggaaatgaagataaactgatttatcaagacttattccaatcaataaaacagcatgcgctgcaatttacacaacaaagcgttacgaaccaaattctcgctgttttagaagcaaaaaaacggcttcattccaatgtgaatgtgcagggattaatggagcacttggtgttaacgttgcaggagggataagcttgtacaacgtaataggcgtccgctttaaaaaagcggggaaaatttattattttgatccgaacggatttgatatagaacaagacagctgcgtcattgttgaaaccgtaagaggtgtagaatacgggcaggttgtcatcgcaaataaacaagtggacgagcatgatgttgtgcttccgcttcgaaaggttattcgcgttgctgatgaacgcgatcttctcattgtagaagaaaacaaacaggaggccctgtccgcttttgaagtctgtcagaaaaaagtggctgaccacggcttagatatgaagctggttgatgttgaatttacgtttgaccgcaataaagtcattttttactttacggcagacggacgggttgatttcagggaattggtcaaagacttggcttctatctttaaaacgagaatcgaattgcgccaaatcggggtaagggacgaggcgaaaatgctcggcggtatcggaccatgcgggagaatgctttgctgctccacgttcctcggtgattttgaaccggtgtccatcaaaatggcgaaggatcaaaatttatcgttgaacccaacgaagatttccggtctgtgcggccgtttgatgtgctgtttgaagtatgaaaatgatgagtatgagacggcaaaagaacagctgccggatttaggcgaaatgattacgacggcaaacggccccgcaaaggttgtcggtcttaatattctggaacgggtgcttcaggtggaactgaagaatcgtgaaaaagtgatagaatatacttgggaagagctcttggaagagggcgtcgtatccgcacaaaccacagattaacgaggtgtggaaccttggataaaaaagagttatttgatactgtcataaacctggaggaacaaatcggttcgctgtaccgtcagctgggtgacttaaagcagcatatcggcgaaatgattgaagagaatcaccatcttcagcttgaaaataagcatttgcgtaagcggcttgatgacacgacggagcaaattgagaagttcaaagccgatcagaaagaaacaaaaacacagaaggcagagcagagtgatataggagaagggtacgacaatctggcccggctgtatcaagaaggctttcatatttgcaacgtccattatgggagcgtccgcaagggagattgccttttttgtctgtccttcttaaataaaaaataaggaaaaggcttccgctgatgtcggaagcctttttcaaagagtgccgaaaggaataagattatggtttcattacgtgatgatgaaagattggattacttattagcagaggatatgaaaatagtacagagtccgacggttttcgctttttcattagatgccgtgctgctgtctaagtttgcatacgttccgattcaaaaggggaacattgttgatttatgcacggggaacggcattgtgccgcttttgctcagcacaaggtcaaaagccgatatcaccggggttgaaattcaggaacgcttgtatgatatggcgcttcgaagcgtggaatacaacgggctgggcggtcagatcagtctcattcatgatgatctgaaaaatatgccggaaagactcggacataataaatatgatgttgtcacctgcaatccgccttattttaaaacaccgaaagaggcggagcagaacatgaacgagcatctcagaatcgcaaggcacgaaatcctttgcacgcttgaagatgtgatttccgtcagcagcaaactgctgaagcaaggaggaaaagcggctctcgttcatcggccggggaggcttctggaaatctttgaactaatgaaagcataccgaatagaaccgaaacgggttcagtttatttatccgaaacaaggtaaagaagcgaataccattttggttgaaggaattaaaggcggccgccctgatctcaaaattcttcccccgctctttgtatataatgaacaaaatgaatatacgaaagagatccgcacgattttatatggagacaaatagtcatttcttttatgtgctgctgtgcaatgacaacagtctgtatgccggttatacaaatgatctgcaaaaacggctgaaaacccacaatgagggaaagggcgcgaaatatacaagggcgagaaggccggtttcgttatgccatgcggaatcatttgaaacaaaacgggaagcgatgcaggcggaataccgttttaagcagctgacccgaaagaaaaaagagcaatatatagaagaaaaacgacgcagcaaggaggctgtatatgttaagacgtcagatgagttttaacggaaaatctgaaatgggaactctgtaccttgttcctacaccgatcggcaatttggaggacatgacctttcgtgcagtagagacgctgaaatcggccgatgtcatagctgccgaagatacgagacagacgaaaaagctgtgccatgtttatgacatagaaacatctctcatcagctatcatgaacataataaagaaagcagcggccataaaatcattgaatggctgaaaagcggaaagaatgtggcattggtcagtgatgccggtatgccgacaatttccgacccgggggctgagattgtgagagatttcacccaaatcggcggatatgtcgttccgcttccgggtgcaaatgcggcattaaccgcgctgactgcatcagggatcaccccgcagccgtttttcttctacggattcttaaacagacaaaaaaaagaaaagaagaaagaactcgaaatcctgaaaaaacggcaggaaacgatgatattttacgaagcgccgcacagattaaaagaaacattaacagcaatgcatgacgttttgggtaatcgaaccatcgccgtcacgagggaattaacgaaaaagtatgaggaattcatcagaggaaccatcgccgaggtgcttgaatgggcaaatgaagatcaaatccgcggtgagttttgtctcgttgtcgaaggcaatcaaggcgctgaaccggatgaagaggaaaagccttggtgggcggagctttctgagaaagaacatgtggagcattacataaatgaaggatcttcttccaaacaggccataaaacaaacagcggtagatcgggacgtaccgaaacgcgagatttatgacgcttatcacattcaatcataaaaaaaaccgttcttgtgtcataacaagaacggtttttgtatgaaatagcttatttttggttttgaagctggttttgaatttcagagatgatttgctcagcgccttctttgctgagtaccaatttgccgccggcaagtttaaggttatcatcagaaacttcaccagttacttggcaagtcatgtttggtttatattttttaaggatgattttttcatcatcaacataaatttcaagagcgtctttttctgcgatgcccagtgtacggcgaagttcgatagggataacgacgcgtccaagttcatcaactttacgtacgataccagtagatttcattaacagtctcctcccgagagataattatttgtagtttatatttttcttcgtcattattcgacaaaattccttacattcctagcataacaaggtttccaataatcgtcaatctttttgtttgctattgtttgtaagaattagttcttatagtaagtaaagccttggaaatcctgaaataacaggctttttgactgctttttcgaacctattatcctactgaaaatccttttaaatcaagactttcgaaccaagatgttttatattagtagattatatacgacaaatttcgacatgttaagactttttttaatttcaataaaaatttttaattttatttactcttttacgcgcagtacgtatatatccttgatcttaaaggctaagatggtatcatagatagaggacaaatatcaatattgtatatcaaataaaaccgctctcgtcctttgggcgtgagcttttcgacattctgaatgggaggttgcaacatgccgcaagacaataatactttttatattacgaccccgatatattatccgagcggaaaattacatatcggccatgcttatactaccgtggcaggcgatgcgatggcgcgttacaaaagattaaaaggatttgacgtacgctacttaaccggaacggatgagcacggacagaaaatccagcagaaagcggaggaagagaatatcacgcctcaagcttatgtggatcgcgcagttgctgaaatccaaaagctatggaagcagctcgacatttctcacgatgatttcatccggacgacggaaagccggcacaaagaaattatcgagaaagtgtttcaaaaacttcttgataatggtgacatttacctggatgagtatgagggctggtacagcatccctgatgaaacattctatacggaaacacagctggtggatgtggaacgaaatgagaagggtgaggttgtcggcggaaaaagccctgacagcggccacccggtcgaattaatcaaagaggagtcatacttcttccgcatgagcaaatatgcagaccgcctgctgaagttttatgaggaaaatccttctttcatccagcctgaatcacgcaaaaatgaaatgattaacaacttcattaaaccggggcttgaagatttggccgtttccagaacgacgttcgactggggcgtaaaagtgccgggaaatccgaagcatgtcgtgtatgtatggattgacgcactgttcaactatattacagcgctcggttacgatacggaaaatgatgagctttacaaaaagtactggccggctgacgtccaccttgtcggtaaagaaattgtccgttttcataccatttactggccgattatgctgatggcgcttgatctaccgctgcctaagcaagtattcgcgcatggctggttattgatgaaagacggaaaaatgtcgaaatcaaaaggaaatgtcgttgatccggtaacgttaattgaacgctacggcttggatgaacttcgctattatctgcttcgcgaagtaccgttcggttcagacggtgtctttacgccggaaggtttcgtagaacggattaattatgacttggcgaacgacttaggaaaccttctgaatcgtacagtcgcaatgatccaaaaatattttgacggcgagattggttcatatgaaggaaatgtgaccgattttgattcagagctttcttctgtagccggtgaaacggttaaagcttatgaaaaggcaatggaaaacatggagttttcagtcgctttatcaacgctatggcaattaatcagccgtacgaacaaatatattgatgaaactgctccgtgggtgcttgctaaagatcaggaaaaagaaaaagaattacgttctgtcatgtatcatttagctgaatcattgcgtatttcggccgtattgcttcagcctttcttgacgcagacgcctgaaaaaatgtttgcccagctcggagttgaggatcagtctcttaaagcttgggacagcattcagacattcggccaattgaaggatgcgaaagtgaaaaaaggggaaccgcttttccctcgtcttgaagctgaagaagaagtagcttacatcaagcaaaaaatgcaaggaactgctcctgctaaagaagaaaaggcggaagagccgcaagaagcagagcgtcttcctgaaattacgtttgatcaatttatggatacagaacttcgcgtcgcagaagtcttgtccgcagaaccggtgaaaaaagcagatcggctgctgaaattgcaaattgatctgggctttgaacagcgccaagttgtatcaggtatcgcgaagcattacacaccggatcagcttgtgggaatgaagatcatctgtgtaacgaatttaaaaccggtaaaactgagaggcgagctttctcaaggaatgatactggcgggagaatcggacggcgttctcaaagttgtagctgtcgaccagtcattaccgaaaggcactcgaattaaataataggggcaaaaggtgtttcacgtgtaacattccgtcgaacaccttttgtttttcaacaagaaaggagtttttatgatgctttttgatacacatgcgcacttaaatgccgagcaatttgacacagacttagaggaagtcattgcgcgtgcaaaggctgaaaaagttgaacgaattgtcgttgtcggattcgacaaacccactatcacgcgtgcgatggagctgattgaggaatatgactttatatacgctgcgatcggctggcatccggtagacgcaattgacatgacagaggaagatttatcatggattaaggaactgtcctctcacgaaaaagtcgtggcgatcggagagatgggccttgattaccactgggataaatcaccaaaagacattcagaaagaagtattccggaaacaaatcgctctcgccaaagaagtgaaccttccaattatcattcataatcgtgatgcaacggaagatgttgtcacaattttgaaagaagagggagcggaagaagtcggcggcattatgcactgctttacggggagcacggaggttgcacggcagtgtatggatatgaatttctatatttcattcggcggaccggttaccttcaaaaatgcgaagaaaccaaaagaagtagcaaaggaaattccgaatgaccgtttgctgattgaaacggactgtcctttcctgacaccgcatcctttccgcggcaaacgaaatgagccaagctacgtaaaatatgttgctgaacagctcgctgaattaaaagggctgacatatgaagaaattgcctcaattacaaccgaaaacgcaaaaagacttttccgcatgaactgacagaatgcgctgtcataacgtgtaaaagcttgtccgattcagtggatatgtaaaacggttctacaagcttccttctcctcataagataggttgtcgatatgtctctcttcctttttttgctttgtttttgcataatgagggatacgctgaaggtttttcatcttcgagatgggagggttgacagcattttagatactctatataatctctccgaggagaaggaggcgtttttcatcacacaaaaaatgaaaaaactgttttccgtaaagcttggtaaaagcaaggttattctgattgcagctattattctgctgggcggaaccgggactgcatacggggcacatgagctctcaaaacaatcagtttctgtttccatcaacggcaagaaaaagcaaatacgcactcatgcaaaaacggttggggaacttctggaagatttacatatagagacgagaaatgaagaccggattaccccgtctaagcagacagcattggcagacaacatgaatgtcgtgtatgatgctgcaaagcagatccgtgtgacaagaggcggagaagaaaagactttatggtcaacggcaaaaacagtcggcgcatttctgaacgaacagcatacacctgtgaatcagcacgataaaatagatccagcagcagatacgaaagtgacaaacggcatgaaagtcacggtcgacccggcttttcaggtcactgtaaatgatgcgggaaagaaaaagaaaatatggacgacttcgactacggtcgctgactttttaacgcagcataagatggacatgaaagacgaagataaagtaaaaccggcattacacgaaaagctcacaaaaaatcaggccggcatacaaatcactcgtatcgaaaaagtcaccgatgtagttgaggaaaaaatagcgtatcaagtgaaagaaaaagaagatgcgtctctcgacagcgggaaagaaaagatcgttcaaaaaggaaaagaaggcaaacttaaaaagcattttcatgttgtcaaagaaaatggaaaagaagtatcaagaaagcttgtcaaagaagaaacatctgaaaaaagcaaagatcagatcattgcggtcggcacaaagcggcacagtcccaagattgagcagctcagtgcacctgtgaaggcatcatcgggcgaaaacggatcttccggtaaagtgattaccgtgtcttccacggcttataccgcaagctgcagcggctgttccggccaaacggctacaggcgttaacctgacaagcaatccgaatgccaaagtcattgcggtagacccaagcgtcatcccgctcggcacaagagtccacgtagacggatacggggatgccgtggccgctgatacaggctcagccattaaaggaagacggattgatgtctttttccctgaaaaatcttcagcttaccgctggggaaagaaacaggtcaaaataaaaatcttaaattaattccgattcattcagagggttttgcgccctctgtttttttcgttataataggtaaagtgtattttcagtatattagacgtgacatgcaagcaaaggtttcgttttggatataaaaagtttttttggaggaagtaatgaaaattaaagaaattattgtagtcgagggacgcgatgacactgcgcgcataaaacttgccgttgatgcggatacgatcgagacaaacggttccgcaatcggagacgaagtcatcaggcagattcggctggcgcaggaaacgagaggggtcatcgtgctgacggacccggattttccgggggagaagatccggaaaaccatttctgaagcagtacccggctgtaaacacgcatttctgcccaaacatcttgccaaaccgaaaaacaagcgcggcattggcgttgagcacgcatccattgaaagcatcagagcatgtctggaaaatgtgcatgaagagatggaggcaaagccgagtgaaatttcagctgaagatgtcatacaggccggtctgatcggcggaccggctgccaaaagacggcgcgaacgattgggcgacctgctgaagatcggctatacaaacggcaagcagcttcaaaaacggctgcaaatgtttcaaatcaaaagaagtgattttattgatgcgctcgatgctatgaggcaggaggaacaggatgaacaataaagatatcgcgacacctatcagaacgaaggaaattctgaaaaagtacggtttctcttttaaaaagagtctgggacagaatttcttaattgatacaaatatattggacagaattgtggaccatgcggaaattacggatcggaccggagtcattgaaatcgggcccggaatcggcgcgctgacagagcagcttgccaaacgggcgaaaaaggtcgtcgcgtttgaaattgatcagcgcctgctgcccattctcaatgatacgctgtctccgtatgacaatgtaacgattattcatcaagatgtgctgaaagcagacgtcaaatccgtcattgaagagcagtttcaggattgtgatgaaattatggtgacggcgaatctcccatattatgtgacgacgccgatcatcatgaagcttttggaagaacatcttccgttaaaaggaattgtcgtaatgctgcaaaaagaggtcgctgagcggatggccgctgatccttcctctaaggagtacggatcgctttccattgcggttcagttctatacggaggccaaaaccgtcatgaccgtaccgaaaacggtgtttgtgcctcagcctaatgtcgattccgccgtcatccgtctcttgcttcgtgacggcccggcggttgacgtcgataatgaaccgtttttcttccagctgattaaagcaagcttcgcacagcgccggaaaaccttgctgaacaaccttgtgaacaatcttccgggcggaaaagagaaaaaagctcaaattgaagaagttcttcaagaaacgaatattgatggaaagcgacgcggtgaatccctgtccatagaagaattcgcgctcttgtccaacggattgcataaagcccttttctaagagggctttttgttttgcgtcaccacttggactgccgctacataggctagaggagaaccttattcattcaactgcaagaaaagcttgaaacatcaagcgccgcagcggaaagaggtgcatttgccaagacttctttcatgatgaggcttagtctatttgtggagtgggtaacgtgcaatttcaaataggagatatggtagccaggaaatcctatcaaatggatgttttatttcgcattatcggtatagagcaaacaagcaacggaaattcaattgccatcctgcatggtgacgaagtcagattgattgcggatgctgatttttctgatttggagcctgtcagaaaagacgaacaggccatgagaaagaaaagagatgaaagcaggatgaatgaatctctcgagctgctccgccaggattataagctgcttcgggaaaaacaggagtattacgcgacaaatcaatatcagcatcaggagcactactttcatatgcccggaaaggtattgcatctggacggcgatgaggcctatttgaaaaagtgcctgaacttttatgaaaaaatcggtgtgccggtatacggaattcattgccatgagaaaaaaatgccggcgtcaattgacgagctgcttgataaatacaggccggatattttagtcatcaccggccatgatgcatattccaagcataagggaggcgtgaacgatttaagcgcctacaggcattccaaacactttgtcgaaaccgttcagagagcgaggcgtaaagtccctcatttggatcagctggtcatattcgcgggggcgtgccaatctcattttgagtctttaatcagagcgggcgcgaatttcgcaagttcgccgtcacgcgtcaatattcatgcgcttgacccggtatatattgtcgcgaaaatcagcttcactccgtttatggagcggatcaatgtatgggatgttctgagaaatacgctgacgagagagaaagggctgggaggaattgaaacgaagggtgtgctgcgtgtcggtatgccgtataaatcaaatggatgagtgataaaacccgcatatatttcgctatgcgggttaattattttacatattgatacataaatttccggaacttgtgaaaaataacgcagaaatcaatagaattttgtcaaaataattttgttgacaatgacttattaacgttgatataatttaaattttatttgacaaaattgggctcttgttgtacaataaatgtagtgaggtggatgcaatggcgaagacgttgtccgatataaaaagatcgcttgatgggaatttaggtaaacggcttacgttaaaagcaaacggcggccgccgaaaaacgattgagcgttcgggcattttagctgagacgtacccttctgtttttgtgatacaactagatcaagacgagaattcgtttgaaagagtttcatacagttatgctgatattctgactgagactgttgaattgacattcaatgacgatgcggcaagctcagtagcattttaatgggcagtgaaccttttgtttactgctttttgttttgccttctaaagctcttctaattattccctcgaaagtttcagccgattaaacggaagctataggtgtcacatgttttatcgtggcgtgcacgaatggtgatcaattctataaaaggggttgtttcgtttgggcagacgtcgtggagttatgtcagatgagttcaaatatgagctggcgaaggaccttggtttttacgatacggtgaaaaacgagggctggggaggcattcgggcgcgtgacgccgggaatatggtaaagcgcgcgatcgagattgccgaacagcagatggcggctcagaaccaaaataaccgataatgcagtggcccgggggacaatccgttccccgggccactgcattatcggctgtcaaaaccggcgtcaatttcggataagtacctccgggtctccaaatgtgatacaatgttcatacttatgtttagatggagaagtaggtgaaagctatgcgtattttagaaaaagcgccggccaaaatcaatctgtccctcgatgtgacgagtaaacgcccggatggttatcacgaagtggagatgatcatgacgacaattgatttggcagatcggattgaactgacagaactgcccgaaaacgttatcagagtggcgtcgcataatcgctttgttccggatgatcaaaggaatctggcttatcaggcagccaaactgcttaaagaacggtttcaagttaaaaaaggcgtttcgattatgattacaaaggtgatccctgtagcggcagggcttgccggcggaagcagcgatgcggcagctacgctcagagggctgaacaggctttgggatttaaagctttctgtcgaagagcttgcagagcttggagctgaaatcggttcagacgtgtccttctgtgtatacggaggcactgccctggcaaccggacgcggtgagaagatcaggcacatcagtgctccgcctcattgctgggtcatgctcgccaaaccgacgatcggggtatcgactgccgaagtgtaccgccggctgaacttacagcaggttcggcatcctgatgtgcaggcgatgattgacgcgattgaagaaaaaagcttccaaaaggtatgcggacaattaggaaacgtgttggagtcggttacgctcagcctccatcccgaggtggcgatgattaaaaatcaaatgaaacgcttcggcgctgatgcggtgttaatgagcggaagcggaccgactgtattcggtttggttcaatacgaatcaaaggtgcagcggatttataacgggttaagaggtttctgtgatcaagtgtacgcggtgcggatgatcggcgaacagaatgctcttgattaaatccgtatgttaagttatattatttttaaattattcggattttgggggtaagttcatgaagtttcgtcgcagcggcagattggtggacttaacaaattatttgttaacccatccgcatgaattaataccgttaacgtttttctcagaacggtatcaatcagcaaagtcatcaatcagtgaagatttaacgattattaaacagacctttgaacagcaaggcattgggacgctgcttacagtgccgggagctgccggaggcgtcaaatacattccgaaagtgaaacaggctgaagcagaagcgtttatacaggagctgggacagtctttagtaaatcctgagcgtatccttccgggcggttatgtatatttaacggatatcttaggaaaaccatctgtcctctctcatgtaggcaggctttttgcttccgtttttgcggagcgggagattgatgtggtgatgaccgttgcgacaaaaggaatccctcttgcttacgcagcggccagttatctgaacgttccggttgtcatcgtacgaaaggacaataaagtgactgaaggctccacggtgagcatcaattatgtatcaggatcgtctaaccgcattcaaacaatgtcgcttgcgaaaagaagtttggctacgggttcgaacgttttgattattgacgactttatgaaagccggcggcaccattaacggcatgatcagcctgcttgatgagtttaatgcaaacgtcgcggggataggcgtcttggttgaagccgagggagtgaatgaacggcttgtcgatgaatacatgtcactgctcacgctttcaaccatcaatatgaaagacaaaacgattgagattcaaaacggcaattttctgcgattttttaaagaacagcatttaaagaatggggagacagaaaaatgactaaagcaatccatacgaaacacgcgccggcagcgatcgggccatattcacagggaatcatcgtaaacaacatgttttacagctcaggccagattcctcttactgctgaaggagaaatggtaaacggtgatatcacagaacaaacgcatcaggtgttcagcaatttaaaagctgtgctgaaagaagcgggcgcttctctcgagacggttgtcaaagcaacggtatttattgctgatatggagcagtttgcggaagtgaatgaagtgtacggacaatactttgatgtacataagccggcaaggtcttgtgtggaagtggcgagactgccgaaagacgctctcgtggaaattgaagtcattgcgctggtaaaatcttaaatctcagaaaagtggttccggtctccgggatcactttttttatgcagtatatgatccccaaatatggtttatcacctaattgtgtatgtatatcctatattttcaaaaaaactttttgaaacgtgcaggaatttaaaaagaatcgtggaattgttagactaatgcttttatatagggaaaaggtggtgaactactgtggaagttactgacgtaagattacgccgcgtgaataccgatggtcgcatgagagcgattgcatccatcacgctggatcacgaatttgtcgtacatgatattcgtgtgattgatggaaacaatggtcttttcgttgcgatgccgagtaaacgcacccctgatggagaattccgcgatattgctcatcctattaattccagcacgcggggcaagatccaggatgctgttttaaatgagtatcatcgtttgggtgattctgaagcattagaatatgaagaagccggggcttcttaaacataacaaaatgtaaggactgctgataaaggctgacacaaggccttttccggcagtccttttttaaatctgatttttcagtaataaagcgattacatagaaaattcttgcactttttgatgtcttcttgaaatcaacagctatttaggatatatttttctatggataaaagggatattggaggccattaaatggataagcggtttgcagtgattttagctgccggaaaaggaacgagaatgaaatcgaagctttataaggtccttcatccggtatgcggaaagcctatggtagagcacgtcgcagacgaagctctgaaattatctttagcgaagcttgtcaccatcgtaggacacggcgccgaagatgtgaagaagcagctcggacagaaaagcgattacgctctccaagcagaacagctcggtacggctcatgcggtcaagcaggcaaaaccatttcttcacggagaaaagggtgtcacgatcgttatttgcggcgatacaccgcttctgacggcggagacgatggaagccatgctgaatgaacatacagacaaaggtgcaaaagccacggtgttaacggccgttgccgacgatcccgccggatacggaagaatcatccgcagtgaagacggcgccgttcaaaaaatcgtggagcacaaggatgcttcggagcaagaacgtcttgtgaaagaaatcaacacgggaacgtactgttttgataacgaggctctttttcgtgtcatcgaacaggtttcgaatgaaaatgcccaaggcgagtattatctgccggatgtgatcgaaatcctcaaagacgaaggcgaaactgttgccgcttaccagactggtaacttccaagagacgctcggagtgaatgatagagtcgctctttctcaggctgaaatgtatatgaaagagcgtattaacaaacggcatatgcagaacggagtcactttaatcgatccgatgaatacgtacatctcacctgacgcgcgtatcggacaagatacagttatttatcccggaactgtgttaaagggacaagctgaaatcggcgatgaatgtgtcatcggccctcacactgagatagaggacagttcaatcggcagccgcactgtgattaaacaatccgttgtcaaccgcagcaaagttgggaatgatgtaaatatcggtccttttgctcacatcagacccgattccgcaatcggcaatgaagtgaagatcggaaactttgttgaaatcaagaaaacacaattcggcgaccgaagcaaagcatctcatttaagctatatcggtgatgccgaagtgggcacggatgtgaatctgggctgcggctccatcacggtcaattatgatgggaagaaaaaatatttaaccaagattgaagacggcgcttttataggctgcaactccaatctggtcgctcctgtcacagtgggagaaggcgcgtatgtcgctgcgggttcaaccgtaactgaagatgtgccgggcgaagcgcttgccattgccagagcaagacaagtaaataaagaagattatgtgaaaaatattcataaaaaataatcctaaaatcggaggtttaccatgtctaacgaatacggagataagaatttaaagattttttctttgaattcaaatccagaacttgcaaaagaaatcgcggataatgtaggggttcaattaggaaagtgctctgttacaagattcagtgacggagaggtccagatcaacatagaagaaagtattcgcggctgtgattgctatatcattcagtctacaagtgcgccggttaatgagcacattatggaattgctgattatggttgacgctctaaagcgcgcttccgcgaaaacaatcaacattgtgattccgtactacggttatgcgcgccaggacagaaaagcaagatcacgtgaaccgattacggcaaaactttttgcaaacctgcttgaaacagcgggtgcgacacgcgtgattgcgcttgatttacacgcgccgcaaattcaaggtttctttgatattccgattgaccacttaatgggtgttccgattttaggccattactttgaaggtaaagacttgaaagatatcgttattgtttctcctgaccacggcggtgtgacgcgcgcccgcaaacttgcggaccgtctgaaagcgccgatcgcgattatcgacaaacgccgtcctagaccgaatgaggtagaagtgatgaacatcgtcggtaacgtggaaggaaaaacagcgattctgatcgatgatattattgatacggccggcacaatcacacttgccgctaacgcgctggttgaaaacggagctgcagaagtgtatgcatgctgtacgcaccctgtattgtcaggccctgccgttgagcggatcaataactctaaaatcaaggagcttgtcgtaacgaacagcattaagcttcctgatgagaaaaaaatcgaccgctttaagcagctttctgtcggaccgcttctggctgaagcgattatccgcgttcacgagaaacaatctgtcagctatttattcagctaaaccgaaactttaaggtttaaatcccagttattgtgggtattgttctaataggacgataaaacgataattaggatggtgctgaatatggcaactttaaaagcaaatgaaagaacagattttaaacgttcgacgcttcggaaaatccgtcattcaggacatgttccagggattatatacggtaaagaaataacgaatacgcctgtctctttagacagtgtcgaattgcttaaaacattgcgggacgaaggaaaaaacacgattatcacaattgatgtcaacggaaatcagcaatcggttatggtgactgatcttcagacagacccgctcaaaaacgaattgacgcacgccgattttcaagtcgtgaatatgagtgaggagctcgaggccgaggtgccgattcagctgacgggagaggcgaaaggagtcaaagacggaggcgttatccagcagccgctgcatgagctttcgatcaaggctaagccgaaggacatccctcagacaattaatgttgatatttccgggcttgaaatgaatgatgtgctgaccatcgcagatctgactgctgacggcaattatacatttacaaacgacccggaagaagtcgtggcttccatccttcctcctaagcaggaagcattcgaagaagatgcagaaccgtctcctgaggaagagcccgaaggagaaaatcaataagcgctttaagacgtaacccgcccgaggttacgtcttttgtgctagaatgagaagaattacagcgatgttgagggaggatttacgatgcttgtgattgccggtctcggtaacccgggaaaaacctatgagaacacgaggcataatgtcggctttatggccattgacgagctttctaaagaatggaatattgaactgaataaaacgaaattcaacggactttacggaatggggtttgtttccggaaaaaaagttctacttgttaaaccgcttacatatatgaatttatcaggagaatgtttgcggccgctgctggattattatgatgccgatcatgaagatctgaaagtcatatacgatgaccttgatcttccgacgggaaaaatcaggcttcggacgaaggggagcgcagggggacataacggaattaaatcgcttatacagcacctcggaacccctgaatttgaccgggtcagaatcggaatcggccgccccgttaacggaatgaaagtcgttgactatgtactgggagcttttacgaaggaagaagcgccgcatatcaatgatgccgtctcaaaaaccgtaaaagcctgcgaagcttccttaacgaaaccatttttagaagtcatgaacgaatttaatgcaaatgtataagataaataatgggagaccatactagggaaaaatgattttttcacatcaggaggtccaacgtatggctttgcattatttctgccgccactgcggctttaaggtagggagcctggaatattcaacggtgccgacacagtcacttggatttcagcacttaacaaatgaggaaagaaacgatatgatttcatataaagacaatggagatgtccatgttcttacaatttgtgaagactgccaagaggcgctggaacgcaatccgcactaccatgaacacaacacatttattcaataagaagctttggtgtagattctagaccaaagcgtttttctgttcttgcagaaaatagagaggagggcccatatggacaacattcaaacctttattaaagaaagcgatgattttaaatccattgtcaacggtttacatgaggggctgaaggaacagctgcttgcgggtctgtcaggttccgcgcgttctgtttttacctccgcccttgcacaggaaacgaaaaggccgattttctttatcacccataatttatatcaggcccaaaaagtgacggaagatctgacggcgcttctcggggatcaatctgtttttttataccccgtgaatgaattgatttcttcagaaattgcggtagcgagtcctgaactgcgcgctcagcggcttgatgtcattaatagattaacaaacggagaagcgccggtcgttgtggcgcccgttgcggcagtgagaagaatgcttccgccgaaggagctgtggaaaagcagccagctcgtcatttcactcggagacgatatagaaccggatcagctgtccgcgcgccttgtagaggtggggtatgagcgttccgatatggtttctgcacccggtgaattcagtattcgcggcggaattatcgacatttatccgctgacgtcggagcatccggtgcgaattgaactgtttgatacggaggtcgattccatcagaagcttcaattctgatgaccagagatcaatcgagacgctcaaacatgtggcgatcggaccggcgaaggaattgatcatcagggcggaagaaaaagcccgggcaatggaaaggctcgataaagggcttgccgacagtctgaaaaagctgaagcaggacaaacaaaaggaaatgcttcatatcaatatctcacatgataaagaacggttatcaacgggacagactgatcaggaacttgtgaagtatctctcgtacttttacgaaaaacctgctagtttgctagattatacaccggcagacacgttgttattgttagacgaggtcagccgcattcatgaaatggaggatcagctgcaaaaagaagaggccgaatttacgacaagtctgctcgaggaagggaaaattctgcatgacattcatttatccttcagctttcaggagcttatgagcgaaaagcggcgcccggctatttattattcattatttttgcgtcatgtccagcatacaagccctcagaatatcgtgaatgtgacaagccggcagatgcagagttttcacgggcagatgaatgtcctctcaggtgaaatggagcgctttaagaaatcaaacttcaccgtcgtctttttaggcgcaaataaggacagaaccgacagattggcatccgtgctggctgattacgaaattgaagccgcgaaaacggacagctccaaagcgcttgtgcaaggacaggtctatgtcatggaaggcgagctgcaatccggttttgaactgccgctgatgaagctggccgtcattacggaggaagagctgttcaaaaaccgaatcaagaaaaagccgagaaagcagaagctgacaaatgccgaacggatcaaaagctattccgagcttcaggtcggtgactatgtcgtccacgtcaaccacgggatcggtaagtacttggggatcgaaacactggaaatcaaaggcattcataaagattacctcaacattcattatcagggcagcgataagctgtatgtccctgtagaacaaatcgatcaggtgcagaagtatgtcggctctgaaggaaaagaaccgaagctttataaactgggcggcagtgaatggaaacgggtgaagaaaaaagttgaaaactccgttcaggatattgccgatgatctgattaagctttatgcggaacgggaagcaagcaaaggctatgcgttctcgcccgatcatgaaatgcagcggcagttcgaatctgctttcccttaccaggaaacagaggaccagctccgttccattcaggagattaaaaaggatatggaaagagaacgcccgatggaccgtttgctttgcggcgatgtgggttacgggaagacggaggtagccatccgagcggcctttaaagcgatcgcagacggaaagcaggtcgcgcttcttgtgccgacgacaatactcgcgcagcagcattatgaaaccattacggagcgttttcaggactatccgattaacatcggtcttctcagccgattcagaacgagaaaagaatccaatgaaacgattaaaggactgaaaaacggaacggtagacatcgtaatcggaacccacaggctcttatctaaagacgtcgtctataaagatctcggcttgctcatcattgatgaagagcagcgcttcggcgtaacgcataaggaaaaaatcaaacagatcaaagccaatgtcgatgtactgactcttacagcgacgccgattccgcgtacgcttcatatgtccatgctcggtgtgcgggatttatccgttattgaaacgccgccggaaaaccgtttccctgttcagacatatgtcgtggaatacaacggcgcgcttgtacgagaagctatcgaaagagaactggcgcgcggaggacaggtatatttcctgtacaaccgcgtggatgacatcgagcggaaggctgatgaaatttccatgcttgttcccgatgcaaaagtggcatatgcccacggaaaaatgaccgaaaatgaattggaaagcgtcatgctcaattttctggaaggggaatcagacgtccttgtcagcacgactattattgagacaggcgtagatataccaaatgtcaataccttgattgtgttcgacggagacaaaatggggctgtctcagctgtatcagctgagaggacgggtcggccgttccaaccgcgtcgcttacgcttattttacgtaccgcagagacaaagtgcttactgaggtggcggaaaaacggctgcaggcgattaaagaatttaccgagctgggatcaggctttaaaatcgccatgcgtgacttgacgatcaggggagcggggaaccttctcggcgcccagcagcacggctttatcgactcagtcggttttgacctgtactcgcaaatgctcaaggaagcgattgaagagcggaaaggcgatattccgaaaagcgaacagtttgagacagaaatcgatatcgagcttgacgcgtatattcctgaaaactatatacaagacggcaagcaaaaaatcgacatgtataaacgcttcagatcaatcgccacaattgaggagaaaaatgagctccaagatgaaatcatcgacaggttcggcagctatcctaaagaagttgaatggctgtttacggttgctgagatgaaggtatacggaaaatatgaacgcgtcgaactcatcaagcaggataaagacgcgatcagatttaccatttctgaagaggccagcgcacagattgacggccagaaattattcgaactcggcaataaatacggccggcagatcggactgggaatggaagggaaaaagctgaaaatctcagtacagacgaaaggccgcaaaacggaagagtggctggagaccgtgctcggcatgctgaaaggccttcagaatgtgaagaaagaaacaatcgcgtcttcataaaaattgttactctctggtgtatattacatttgatgtgacggatactaatttcaagcgagtggcggaagctacataaagtaaagagctttagtactttcccttaaatatcatcacatgaaagagaggcaccagagagatgaaagctacaggtatcgtacgtcgtattgatgatctaggacgggtcgtcattcctaaagaaattcggagaacactgcgaatcagggaaggagacccgcttgaaatattcgttgaccgcgacggagaagttatattgaaaaaatattctcctatcagtgagcttggcgattttgcgaaagaatatgcagatgcattgtatgacagtctcggccattccgtcttgatttgcgaccgtgacgcgtatattgccgtttcgggcagttcgaaaaaagaatttctgaataaagccatcagcgatttgctcgaaaaaacgatggatcagcgcagctcagtggtagaaaacgacgtgaagtccgcgcagcttgtgaatgacattgatgaagatatgagctcctatacaatcgctccgatcgtggcaaatggcgatcctatcggtgccgtggtcatcttttccaaggaacaggcgcttggagaagtagaacataaagcggtagaaacggcagccagttttttggcgagacaaatggagcagtaggtcttattaccattattgaaataagaaaacggggaaagaacagctcttatacaagtgctgttctttttcatattcatatgtgctctctatcggttcggccgttaggattgtgatataataagctcgttttatagacgtaattttctagcggctggaaggagcttttggatgaacgattcagttggcgccaagcggcaatcggcatggaaaggtgcttttgtgctcgtcgttgcgggcatcgtgacgaagatattaagcgccgtgtacagggttccttttcagaatattgtcggtgacgtcggattttacatttatcagcaggtgtatccgtttttagggatcgcggtcatgctgtcaacatccggttttccggtgatcatctcaaaattaatgaacgattatagcgatcataaacaaaaaataatgaaaatttccgccctttatgtcacggcggccggacttgttctgtttgcgctcatgtatgccggcgcggcgccgttggccggttttatgggtgatgcccgccttgtgatgctgataagggtcgcggcgttcgctttcatactgtttccgtttacggcggttttccgggggtatttccaaggcgtgcatgatatgatgccgtcagccttatcccagattacggaacagcttcttcgggtggcggtgcttctcggtttatccttctggcttttgaaaagcgggcgttcattatacgcggcgggtgcgggggcggcctcgggatcaattgccgggagctttgcggccctttgtgtattggctgttttctggtataagcgggaagaaacaaagaaagacggcggacatatcgaaacggccgtcattgtaaaaaagctgctgctttattcagtcaccatctgtatcagcagtgtactcatgcttttgattcagcttgtagacgccttaaacttatattcactgctttcagacgggacggagagccatgccgcgaaacagctgaaaggcatatatgaccgcggacagccgctccttcagctgggaaccgtgtttgccgtcagtatcgccgcgtccttggttccttcaatttcaaaagcggtgcatgagaacaagccgtttatcataaaagagaaagcgtcatctgccgtcaagctctgccttgcggtagggatcggtgcatcagccgggcttttttgcattttagaaccggtgaatatcatgcttttccaaaacagtgaggggacgccgaccttacaaatattcagcttatctatcttttttgcctcgattgcgcttacggcagccgcgattctgcaaggagcgggacataccgttttccccgccgtatccgttttggcgggaggggcgctgaaatgggtgctgaatgtttggctggtccccggctggggtattacaggagcggcactggcgaccgtcttggcatttgccgcagttgcgtgcctgaatctccggagaatttggtcgaagggatggctgacgaatatcggaggcgtgattgcccgtctgtgctggtgcagtctgctgatggtcttctttttggtcgtatacatgaagctttggcagttatttgttcctgtcagcaggggcggagctgtatgtgagagtctgtctgcgtcaatcatcggagggctattgtttatttattgtatgataagaatgaagattttcacggacgaagagctgagcggtcttcctttcggcagtgctttaagcaaattgaaaaagaggagagaaaaacatggcaggtaatattacggtcgtcggcctcggcgccggagacatggatcagttgacagtgggcgtacataagctgctgactcaggcgaagcatttatatataagaacgaaagaccaccctttgatttcggaattagagcaagagacggaagcggacatccggtattttgatgatatttatgaaaaacatgatcagtttgaagcggtctatgaagagatcgcggacattctgtttgaaaaagcgaagcaagaggatgtcgtctacgctgtacccgggcatccgtttgtcgctgagaaaaccgttcagctgttatttgaacgccgggaagaacaacagatagatgttcatactgccggagggcaaagctttctggatgccacttttaatgcgttgcgaattgatccgattgaagggtttcaatttacggatgcgcaaacaatgacgccggatgagctcgaactccggcatcacctgatcatctgccaggtttatgaccaaatgacggcctctgaggtgaagctgacgctcatggagaaattgcctgacgactatgaagtggtcatcgttacggcagccgggagcaagggagaaaagatgatcaaggtgcctttgtttgaacttgaccgcaatgtagaaataaataacttaacaagcgtgtatgttccgccgattaaaaaagaagaactcctttaccaggaattttctgcattccgaagtattattcgcgagcttcgcgggccgaacggctgtccgtgggatcaaaagcagacacaccagtcattaaagaaatatatgattgaggaatgctacgaactgcttgaggccattgacgaagaggacacggatcacatgatagaagaactcggggacgtcatgcttcaggttatgctgcacgcccagatcggagaagacgaggggtatttctcaattgatgatgtcatcagagacatcagtgcgaagatggtcagacggcacccgcatgtgtttaaggatgttaaggttcaggatgaacatgatgtcgtcgccaactgggaagaaatcaaaaaggcggaaaagcaaacaacatcctcttcattgctggatgccgtgccgaaaacactgccttctcttgcgaaagccgccaagcttcagaaaaaagccgcaaaaaccggctttgactgggatgacgttcaggatatatgggataaagtaaatgaagagctgaaggaattttctgcagaggcttccgccgaatcagcagatgaaatcagcttaaaagctgaattcggcgatgttttatttgcattggtcaatatcggccgatactataaaattgagcctgaggaagcgctcgccatgacaaatgacaaattccgcagacgctttgcttatattgagaaagaagcggcagcaaagggccttgaattgaccgcaatgtcacttgaggaaatggacaaattgtgggatgaagcaaaagaaatggagaggagattctgatatgagacttgataaatttttaaaagtatccagattaattaagcgacgcacattggcgaaagaggtcgccgatcaagggagaatcaccgttaacgggaatcaggcgaaagccagctcagacgtaaaagccggtgatgaactgaaggtccgcttcgggcagaagcttgtcaccgtgaaggtaaatgaattgaaagaaacaacgaaaaaagaagaagccgcgggcatgtatacaatcgtcaaagaagaaaaactcggcgaataggcttgttctaaacaaggctcccgcctcatacaatgcagtaataatgctaaaagtatcgaggatatgggggctgaatagatgaattcatattatgagcaaaaaggttcttcttctgttccggaacagcatgatgtaacgatgaaagggagaaagcatttagacatttcgggcgtcaagcatgtggaaagttttgataacgaagagtttttgctggaaacggttatgggaatgctttccgtcagaggcgagaatctgcagatgaaaaaccttgatgtggaaaaagggattgtatctataaaaggcagggtgtttgaccttgtatatttagacgagcagcaaggggataaagctaaagggttttttagcaagttgtttaaatgacgctgacgacccaattttatacgatgctggcaatgaccggtatgggcgcctggctcggagcgtcgcttgatacatacaggctgtttgtcagccgcgccaaaacggccagatggctgttattcattcatgacattctcttttggattgtacaaggtctgctgtttttctatgtgctgctcaacgtgaatgaaggggaactcagggtatacattttcttggctgtcttactgggtattgcgacgtaccaaagcctgtttaaacgaatgtatataaaaatactgaaatttgccattcatcttgcggtgtctctttaccaattcgcaaaaaagctcattcagcacgtgctgttccgtccggtgcttctgctctttaagctgctcatcgggctgatcacggttatttctttatactcctatcgggtgagtgccttttttgcgaagtgtctttttaagatcgtagcgtttttgctgtatccgctgtttttcctgttgaaacaattattgaaacttcttcctgaaaagtggcgtcttactttcaaacgatattttcaaaaaagtgcaggatttttacaaaagagcaagaaactaatcataacaatcagatcgaccatgatacgtattttgaaaaggtgaaaggaggaccgtctggtttgaatctatctagggaacgtacaataactgaaattcaaaacgactataaagagcaggttgaacggcaatcccagcttatgaaaagaaggcggaaagggcttttcagacggttgatcgtattcggcgcccttgtgttgttgacggctattgtcttagcgggttctctgtggtcacagacctcttcccttagcgcaaacgaagaaaaaaaggctcagctggaaaaacaagtaaaagaattgaatgcgaaacaggctgatttaaaagatgaaatttccaaattaaaggatgaggattacgtcacagagcttgccagaagagacttgtttatgtcaggaaatggtgagattctctttaatgtagaaaagaagagcaagtagccttgttgacacttaaatttttatttaggtataattaaacaaacgatctttttataagcctaaggaggagcactttttttatgtcgattgaagttggcagcaagttgcaagggaaaataacaggtattacaaatttcggagcatttgttgaattgcctggaggctcaaccggtctcgttcatatcagtgaggtagccgataattatgtaaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataacttgctgctttctataaatacatggagcatccgtctatcccagcgggtgctttttttgtatacgcgcatgtagtcagaaaattaaaactttaaagtttctgttgacggaatgaagaaacctttgtattatataacttgtgcttataagcacctatatggcggtgtagctcagctggctagagcgtacggttcatacccgtgaggtcgggggttcgatcccctccgccgctaccatatatatctggcccgttggtcaagcggttaagacaccgccctttcacggcggtaacacgggttcgaatcccgtacgggtcatcaagcgaatcggcttctgttgcagaagccgattttttcatatttagacaactttttgagaaatgtcggaggaaatacaaaaggaaaggggaacaagggagaaagcgtcgaagagttctttggaattgttaccttcttttgacaaaatcctatctgggctttcatttataatgacaagcaacgaataaaacaggtgggggatgagagcaatggaaaaagcggaaagaagagtgaacgggccgatggcgggacaagctctggaaaaactgcaatcgttttttgaaaaggcggcaaagcttacagtccatcaagcgcattcactttttttctataagggtttcatttatgtcgtgatcggttttttacttggacgggctttcatattatctgaggttcttccatttgcactgccgtttttcggagcgatgcttttgatcagaagagataaagccttctatgcttgtctgtctttacttgcgggcgctttaaccatttcgccgaaacactctttattgattctcacagctttggccgtcttcactctattttcaaaaatcggtacatatatcgtgcaggaccgggtgaagatgctgccgatcgtggtgtttttctctatggctgccgcgagaatcggatttgtttattttgaaagcggcgcttttaccacctatgattatgtgatggctgttgtcgaggcgggcctggcctttattttgacgctgatctttttacaaagcctgccgattttcacgatcaaaaaagtgaagcaatcgttaaaaatagaagaaatcatctgttttatgatcttgatcgcatccgttttaaccgggcttgccggtgtttcatttcagggaatgcaggctgaacatatcctggcccgctatgtcgtgctgagtttttcctttgtcggcggggcaagcatcggctgtacggtcggtgttgtgaccggactgatcctcgggcttgcgaatatcgggaatctctatcaaatgagtctgcttgcgttttccgggcttcttggcgggctgctgaaagaaggaaagaaagccggcgccgcagtcggattggtgatcggctcactgctgatttcattatatggtgaagggtctgccggattaatgaccactctttatgaatctttgattgccgttgtattgtttttgattacgccccaatcgattacgaaaaaggtggcgcgatacataccgggcactgctgagcacagtcaggagcagcagcagtacgcgaggaaaatcagagatgtcaccgcccagaaagtagaccagttctccaatgtgtttcatgccttgtcggagagcttcgccacctttcatcagacgtcttccgatgagcaggcggaagaaggggaagtggatctctttttaagcaaaatcaccgagcattcctgccaatcctgctataaaaaaagcaaatgctgggttcaaaactttgataaaacatatgacttaatgaaacaagttatgcatgaaacagaagaaaagcagtatgcctcaaaccgcagattgaaaaaagagtttcaacagcactgttccaaatccagacaggtggaagagctgattgaggacgaacttgcccaccatcacgcccatctgacactgaagagaaaagttcaggacagcaggaggcttgttgccgagcagctgttgggggtttctgaggttatggcggacttttctcgggaaataaaacgggagagggagcagcattttattcaggaagaacaaatgatagaggcgcttcagcatttcggaatcgagattcagcatgtcgagatatacagcttggagcagggcaatattgatatcgaaatgacaatcccgttcagcggaggacacggcgagagtgagaaaattatcgccccgatgctgtctgacattcttgaggagcagatacttgtcaaaagcgaacagcactcggctcatccgaatggctacagccatgttgcgttcggttcgaccaaatcgtaccgggtatcgacaggcgcggctcatgcggcaaaaggcggcggccttgtctccggcgacagctacagcatgatggaactgggggcgagaaaatatgcggccgcaatcagtgacggcatgggcaatggggcgagggctcattatgagagcaacgaaacgattaagctgctcgaaaaaattctcgaatcaggtattgatgaaaaaatagcgatcaaaacgatcaacagtattctgtctttacggacgacagacgaaatctactcaactctcgatctttctatcattgatcttcaggatgcaagctgcaaattcttaaaggtcggttcaacgccgagttttatcaagcggggagatcaagtcatgaaagtgcaggccagcaatctgccgatcggtatcatcaatgaatttgatgtggaggttgtaagtgaacagttaaaagcgggagatctgctcgtcatgatgagtgacggtatttttgaaggaccgaagcacgttgaaaaccacgacctgtggatgaaacggaaaatgaaagggctgaaaaccgaagatccgcaggaaatcgctgatatattaatggaagaggtcatcagaacgcgttccggccaaatcgaagacgatatgacggtggttgttgtccggattgatcacaacacgccgaaatgggcttccataccggtgccggcggtattccaaaataaaaaggagatttcttaatcctttcgtataaatcactttccttctggcgaagatgggactaatcgtatcaccgggaggaatgtatgtgaataagggacatttaaatcaagttctgctgattacagatggctgctccaatcatggtgaagacccgattgcaatggcggctttcgccaaggagcaggggattacggtgaatgttatagggattatggaagaaaacgcgattgaccaagaggcaatgaaggaagttgaaggcatcgccatggccggtggcggcgtccatcaagttgtatatgcgtcacaattgtctcagacggttcaaatggtgacgaaaaaagcaatgacccagacgctgcaaggtgtcgtcaatcaagagcttaaacaaatcttagggaaaaacgttgaaatggaagagctttctccggaaaaacgcggcgaagtgatggaagtggttgatgaactcggagaaacagttcatctgcaggtgcttgtgctggttgatacgagtgcgagtatggcgccgaaactgccgacggtgaaagaagcgctgattgatctttccatcagtttaaattcccgggccggacaaaatgaatttgccatgtgtatatttcccgggaaaagccaggaagttgagcttgtgctgaattggacgccgaagcttgaatccctttctgcgctctttgcgaagctgtcgaccggcggtatcacccctacgggccccgctatccgggaagcgacgcagcagtttgagagaatccgctcaagaaggagcatgttggcagatgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaataagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcttgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacaggggctattgggggtatggaacaagaaaagcagaaccatcctatgacctgtttgctgtcgcaatgatcatgatccactgtgtccagaagaaagagtgcaaaaagtcaggacagccgaaagaacagcttcgttctatcattgaaggccacccgtttctgaataagtataagaaggttctgttttctgctttaaacggccaatatccgtctgcggaagccatgaagcatgacatcctgacggcggggcagagcgccgggagtaaaaggaaagccgccgccaagcctaagccgccgcaatcaaaaccgcggcagggcactgtatctcaaacgcggtataaacctaaacaaaaacccgcaaagcacaatggtttgtttgaaacaacgcttattttaatcagcgttctcgccctttatttcgcttacatcgtcttttttctcatctaatgccggccggacgcctgcgctcatgcttcttctttgcttggagggaatgaaagtgataggatatgtatatctttaaaaaaacctgctcattgtgagggggacattgtgaaaagcgtggaagattttttcaaaacatatcatcttcaggcggagggagaaacgattattgccggggtctccggaggccctgattcaatggcgcttctcagtatgctgaataagcacttcgggcattcttccgttatcatagcggcgcatgtcgaccatcagttcaggggtcctgaatctgaagaagatatgaagtttgtgcagtcatattgcgaagcggaacacatcctctgcgaaacggtacagattgatgtttctgcatacgcaaagaagaataagctgaacaagcaggctgccgcgcgtgattgcagatatcagtttttcgaagatctgatgacaaaacaccaagcgaagtttttggcgctggctcatcacggcgatgaccaggttgagacaatgctcatgaggcttgcgaaaggtacgctcggcgcagggctcgcgggaatgcagcccgtccgcgaatttgcatccggctggctgatcaggcctttcctctatgcggaaaaggatgaaatcctagaatactgccgtcaagaagggctcagctacagaacggatgagagcaatgcaaaagacgattatacaagaaacagattcagaaagaccgtgcttccttttttaaaacaagaatcacctgacgttcataaaatgtttcaaaaggtgagtgaagcactgacagaagacgaacaatacttgcagtcattaacgaaagaacgaatgaataaggttattacaagcaagtctgacacatcggttgaagtcgattcctctcaattgcttgcccttccgatacctttacaaagaagaggagttcaactaatattaaactatctttatgaaaacgttccatcgtcgttttccgcccgccacatacagcagtttctggaatgggcggaaaatggaagcgcctcgggagtgcttgattttccgaaagggctgaaggtggtcaaatcatatcagacatgtttgtttacatttgaacaatggcaatgtgaaaaggttccctttgagctgcagctgcaaggagcggaaggcgagactgctgttctccccaacggctttatgatagaggtggccgatcaggctgaccctcatatcaaaaatgggaatgctgtttttatgacaagcagaaataaggtgcaatttcctttaacaatccggacgagaaaaatcggcgaccggattaaacttaaagggatgaatggctcgaaaaaggtaaaagatatatttattgatcataaactgcctctgcgggatcgggacgaatggccgattgtaacggatgcgagcggtgaaattatctggctgcctggcttgaaaaaatccatctttgacgatcttgtgatttcaaacagtgaccgcattgtattacaatatagacagcatgaaaagtgtagggggcaagcattaacatgaaacaggatatcgaaaaagtgctgatctcagaagatgagatccagcagaaagtaaaacagcttggagaacaattaacaagcgagtacagcgacacgtttccgttggcaatcggtgtgttaaagggagcgcttccttttatggctgatcttataaagcatattgatacatatttggaaatggacttcatggatgtatcaagctacggaaattccacggtttcttccggagaagtcaaaatcatcaaagatttggatacatctgtagaaggccgggacatcttaatcattgaagatattatcgacagtgggttaaccttgagctatctcgtagaactcttccgatatcgtaaagcgaaatcaattaagattgttaccctgttggataaaccaagcggaagaaaagcggacattaaagcagacttcgtaggctttgaagttcctgacgcgtttgttgtgggttacggacttgattatgccgagcgctatcgcaatctgccttacatcggagtattaaaaccggcgatttatgaaagctgatcggctgcctgcttccgagatggttatcggttgtattggaatgattttctatggtactattgaacatagttgtgcttactgtgggaggaggtaaggaatgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgacaaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgattgttccgagggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaattgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacatcctgtctaaaacagaagacgaaaagaaagacgagccgaaagaatagttcgctttctgatatgaaaaccgccggcgtataccggcggtttttttactggttccgttttgtttacaaaagagccgcagatcgtgtatggtattgtagaatgttgaaaatgttatgattagaaactattcaaaagtggtgatagaggttgttactggttatagatgtggggaacaccaacaccgtgattggtgtatatcatgatggggaattagaatatcattggcgcatagaaacgagcaggcacaaaacagaagacgaattcggcatgctgctccgctccttatttgaacattccggactgatgtttgaacagattgaagggattatcatctcatccgtagtgccgccgattatgttctctttagaaagaatgtgcacaaaatactttcacatcgagccgcaggttgtcggcccgggaatgaaaacaggtttaaatataaaatatgacaatccgaaagaagtgggagctgacaggatcgtcaatgccgttgcagcgatccagcagtatggcggccccttaattgttgttgatttcggaacggcgacgacgtattgctacattgatgaaaacaaacaatacatgggcggtgcgattgctcccggcattacaatttcaacggaagcgctgtactcacgcgcggccaagcttccgagaattgaaatcgcccgaccggataatatcatcggcaaaaacacggtaagcgccatgcagtccggcatccttttcggctatgtcggacaagttgaaggcattgtaaagcggatgaaatggcaggccaaacaagaaccgaaagtcattgcgacaggggggcttgcgtcattaatcgcaaacgaatcagactgtattgatattgttgacccgtttcttactttaaaagggctggaaatcatttatgagcgaaatcgcgtgggtcacatataggaggtaaacgatggattatttaattaaagcaattgcatatgacggtaaagtgcgggcttatgcagccagaacgacagatatggtaaatgaagcgcaaagaaggcatgacacgtggccgacggcatcagccgcaatcggccggacgatgacagcgtctctgatgctcggagcgatgcttaagggtgaagataagctgacagtcaaaatagaaggcggcggcccgatcggagccattgtcgcagatgcgaacgcaaagggtgaggtaagagcatacgtatcaaacccgcacgttcattttgacctcaatgaacaagggaaactggatgtcagacgggcggtcggaactgacggaacactcagtgtcgtaaaagatttgggcttgcgtgattattttacggggcaagtagagattgtctcgggtgaactcggtgatgacttcacgtattaccttgtttcttctgaacaagtcccttcatctgtcggggtaggtgtactagtaaatcctgataacacgattctcgctgcgggcgggttcatcattcagcttcttccggggactgatgaagaaaccatttcaacaattgaaaagcaattatctcaaatcgaaccgatttcaaaattgattcaaaaaggcctgacaccggaagaaatcttagaagaagttctgggtcaaaaaccggacgttctcgaaacaatgccggtcaaatttcactgttcttgttcaaaagatcgattcgaaacggccattttaggactaggcaaaaaagaaatacaagatatgatagaagaagacggaaaagccgaagcggtttgccatttttgtaatgagaaatatttatttacaaaagaagaactggaagagcttcgtgacgaaacaacccgctagctctttagcgggttgttctattttgtaaaagggatggggtagattttgaaatcgagaacacttttgacgattattgtagcggcgctgttggtatgcagtgtagcagtggcgtataagttaacaaaatcccaagccgcggggtcatctgaagaatccatcgcgacaatcggtgataaacatatcacacggcaggactggatgaaaaagatggaagacgagtacggaaaatcaactctggaggatatgattaatgcacaagtagtggaagaacttgcgaaaaagaataaactcacagtttcaaacaccgaattggaacgtgaatttcttttaatcaaagcggtgaataattcattttatgaagacagccatattaccgaaaaagaatggagagaccagatccgctacaacattcttcttgaagaactgctgacgaaggacatcgatatatcggataaggaaatgcaatcattttataataaaaataaagaactgtaccatttcgatgattcctacagaatcaggcacattgtcgtcaaaaacaaggaagaggcggacagggtgcttgctgatttgaaaggcggttccagctttgaagccgtcgccgctgagcgttccacggacagatacacgtctcagtatggcggagacctcggctttgtgacagaaaaccaggaaaatatcccgcaggcatatatcacagaagctaaaaatctcaaagaagatgaatggtccgctgaaccgattaaagtttcttcaggatatgccgtcattcagctgaaagaaaagcttaaagcgagaactttctcatacaatgaagtgaagagtcaaatcagacgccagatcgcgatggatcaattaggtgacaaggcgacagtcaaaacgctgtggaaagaggcgggggtctcttggttctacggggaaaaaagaactaaatgattgacaaaaaattttgaaattgataacttatatttataataccaataaatttagtcggaaattgaggtgtccaacatggtgcgtattgcaaattctattactgaactaatcggaaatactcctattgtgaaattgaatcgcctgacggatgaaaacagtgcagatgtatatctgaagcttgaatacatgaatccgggcagcagcgtaaaagaccgtatcggagcggcgatgattgaagcggctgaaaaagaaggaaaattaaaagccggcgacacaatcattgaaccgacaagcggaaatacaggaatcggtcttgcgatggtggcagcggctaaaggtctcagagccattctcgttatgcctgatacaatgagtatggaacgacgcaatctgctgcgcgcatacggagcggagcttgtgctgactcccggcgcagaaggaatgaagggcgccattaaaaaggcggaagaacttgcggaggaacacggatactttgtgcctcagcaattcaacaatgcggcaaacccggaaattcaccgccaaacgacggggaaagaaatcgtagaacagtttggtgacgaccagcttgatgcgttcgtggccggaatcggtaccggcggaaccatcacgggagcgggcgaagtgctgaaaaaagcatatccatccatcaaaatctatgcggtagagccggcggattctccagttctttccggcggaaaaccgggtccgcataaaattcagggtatcggagcgggatttgtccctgaaacattgaatacggacatctatgatcaaatcattcccgtcaaaaacgaggatgcatttgaatatgcccgtaaaacggcaaaagaagaagggattctcggcggtatttcttccggagcggccatttacgcggcactggaaatcgcgaaaaaactcgggaaaggcaagaaagtgcttgcgatcatccctagtaacggagaacgttacttaagcacaccgctttatcagtttgaatagagacatacacacggctcccggctgtatccgggagtttttttgtgcctgaagtatcgaaaatccaaaaaacgtttcgaattttatggttggaagtgaaattcacttttttcaccagtgtgattgctttaaaataaaactacagtaaaacgaagcagaggattgatatgatggcacaacgcagaccggcaggaagaaaaataccttttacgaaacaagcatttttacagcgatatgaaaacctttcgaaatcgagaaaacggcatgttctgctcgaaagcgcgagagggggaagattcagtatagccggtctagatccgattgcgtccgtcagagggaaagacggaattacaacgatcaagcatgagggagaaacactgtttaaagaaggtgacccgctgcgggcctttcatgaatggtttggaacgctcggaacggaaacaaacgttgagtttccggactttcagggcggtgcgattggttttatcagttacgactatgcccgatatattgagaattttaagatgctgtcgttagatgatctggaaacacctgatatttactttcttgtttttgatgatgtggccgtttatgaccatgaggaagaggcgttatggctcattacccatactgaagcggaagaagcggatcttgcggaagaaaagctgtccggcttagaggacatgtggtgttccctccaaacggcggacgagcctttttcaccgctgaatcggaatggggacggatcgtacgccgctccgttcaccgaggaaggattttcacaggctgtagaacaaattaaacaatatatcgcgagcggggatgtgttccaggttaatttgtccatcaggcagtctcagtctttatccgttcatccgtatgaggtgtataaacacttgcgaaacgtcaatccgtctccttacatggcctatctcgagacaccggggtttcaagtgatatgcgggtcgccggagctattggtgacaaagaaggggaagaagcttgaaacgagaccgatcgcgggtacgcgttcaagaggaaaagacgatgctgaagacaaggctttggctgatgaattaattcacaacgaaaaagaacgtgcggaacacgtcatgcttgttgatcttgagcgtaatgacctcgggcgcgtatcgcgctacggctccgtgcgggttaacgagtttatggcgatcgaaaaatattcccacgtcatgcatatcgtgtcaaacgtacagggagagctgcaggacggatatgacgcgacagacattattcatgcggtgttcccggggggcaccatcacgggagcgcccaaagtgagaacgatggaaattatagaagagcttgagccgacaagacgggggctttatactggatctataggctggttcggattcaacggagatttgcagtttaacattgtgatccggacgatctatgcagccggcggacatgcttttatgcagtccggagcaggagtggttattgattcggttccgaagcatgaatacaaggaatcgttcaaaaaagcttttgcgatgaaaaaggcgttagagctgagcgaagaagagacaaaaaatcagacgaggtgagcagagatgattttaatgattgacaattatgattcatttacgtacaacttggttcaatatttgggtgagctcggggaggaactgatcgtcagacggaatgacgagattacgattgagcagattgaagagctgggtccggacttcttaatgatttctcccgggccgtgcagtcctgatgaagcggggatcagcctcgaagccatcaaacattttgccggcagtattcctattttcggcgtatgtctcgggcatcagtcgattgcgcaagtattcggcggcgatgtcgtcagagcagagcggctcatgcacggcaaaacgtcagaagttatgcatgacggacagacgatttttaacggcctgcaaaatccgctggtcgccacccggtaccattcacttattgtcaaagcggacacgctgccggattgttttacggtatccgctcaaaccaaagaaggagaaattatggccatccgccataatgagctgcctgttgaaggtgttcagttccatccggaatccatcatgacctccttcggcaaagagatgctcagaaactttatagagacacaccgcaaaaaggaagtatcggtgtgattatatatttgaatggtcaatatatagaggagaaagaagcggcgctttctccttttgaccatggttatctgtacgggatcggagcgttcgagacgttcaggctttacagcggccggccgtttctgccggatgcgcatgtcgccaggctcaacagggcgcttcgggatctgcagattgcattcgaggtgaacaaacaggagctgcttgatatgcttcggagactgttgcttctcaatgacataaaggacggcagcgcgcgtgtccggcttaacatctcggcaggcgtcagcgataagggatttgccgcgcagacttatgaaaagccgaccgtcctttgtttcgtgaaccggctcaatccggaaactctgcctgttcaaaaagaaggcaggcttctctctgtccggagaaatacgcctgaaggatctttccggttaaaatcccatcactatttaaacaacatgtacgctaaacgggagatcgggaatgatcccaatcttgaagggattttcctgaccggagaaggagatgtcgcggaaggcattgtctccaacgtgttttggcgaaaaggagacaaggtctttacgccatctttggatacgggaattctcgacggtgtaacaagacagtttgtcattgatgaattgaaacggcaggggacagaagtcaccgaaggccgattccgttttcaatcaatgcttgaagcggatgaagcatggttgacaaactccgtgcttgaaatcatcccgttttctaaaatagaggaagtgccgctgcccggaatgagcgggaaaacggtgcaattgctccgtaagcagtatcggcaggaaataaacaaaatgaatgtacaggaggaggaacaaaatggcgcagcaaacaattgaacagcctaaactgattcatacaaaaaaaggcgctctgtcctataaagagaagacgctcgttatggggatattaaatgtaacgccagactccttctctgacggcggcaaatacgacagtacggaaagggcgcttctgcatgcggcgaagatggctgaagaaggggcgcatatcatagatatcggcggcgaatcgacaaggcccggcgcatcactcgtttcggctgatgaggaaatgtcacgagtcatccccgtcatagaacggattacaagcgagctggacattccgctttcaatcgatacgtacaaagcgtccgtggcagacgaagcggtcaaagcgggagcctctatccttaatgacatctggggggcgaaaggtgaccctgacatggcgtcagtagccgccgcacacggagttccgattatcttaatgcataatcgtatggaaagaaactataacgatcttattcctgatatgcttgcagacttgatggaaagcgtaaaaattgccgcagaagccggcgtcacagatgaaaacatgattctggatccggggatcggctttgcgaaaaactatgaggacaatctggctgtcatgaacaagctggaggtgttcagcgggttagggtatccgctgctcctggcgacatcgagaaaaaggttcatcggccgtgtgcttgaccttccccctgaagaacgtgccgagggaacgggagcgacagtatgccttggcgtccaaaaaggctgcgacattgtgagggtgcacgatgttaaagagatcgcaagaatgactaagatgatggatgctatgctgaacaaaggaggcgcgcattatggataaagtatatgtggaaggtatggagttttacggatatcacggcgtgttcgaggaagaaaacaaactcggccagcgcttcaaagtagacctgactgccgaactggatttgagcaaagcgggaaaaacggatgacctttcttataccattaactatgcggaattgtacagtgtctgccgcggcatcgttgagggcgagcccgttaatttggtcgagacccttgcggaacggatcgcagacaccgtccttgagaaatttgagccggtgcagcaatgtacggtaaaggttgttaagcctgacccgccgattcccggccattataaatcagtagccatagaaatgacgagaaagaaatcatgaacaatacggcatatatcggcctcggttccaatatgggcgaccgtgaacattatttgcgccaggcagtggccatgctcacccggcatgatggcgtgacggtgtcaaagatatcctctatatatgaaacagatcccgtcggttatgaggatcaggatcagtttctcaatatggcggttgaagtgaaaacgtcgttatctccttttgaacttctagatgtaacacagtccattgaagctgaattaggcagaacgagagagattcgctggggaccgcggacggcagaccttgacattttgctgtataatcgtgaaaatattgaaacagagcggctgattgttccgcatccgagaatgtatgagcgcttatttgtccttgcgccgttaaaagaaatatgtccgcaggcggatcatatcacgataagcgctgaaacaaaccaagaaggtgtaagagtatggaagcagaaatctggggtaggcgaattcgtgcattcagaaagctgaaaggttatactcaagaaggatttgcaaaagcattaggtatatcagtttctattgtcggtgaaattgaacgcggaaaccgattgccgtcagatgccatcattcaagatgcggcagatgttttaaatataagtgcggacgaattggccccgcctgaaaaatagacaaatgaaaggaggggaaaaatgtttaaaatcggtgatattcaattgaaaaaccgggttgtgcttgcccctatggccggtgtctgcaactcagcgttcagattgactgtaaaggaattcggagccggattggtatgcgctgaaatggtcagtgacaaagcgatcctttacaacaacgcaagaacaatggggatgctttacattgatgaacgtgaaaaaccgctcagccttcagatttttggaggaaaaaaggaaacccttgtggaagcggcgaagtttgtagatcaaaacacgactgctgatattattgatattaacatgggatgtcccgtacctaagattacaaaatgtgatgcgggcgccaaatggcttctcgatcctgataagatttatgaaatggtatccgcagtagtagatgctgttgataagccggttacagtgaagatgagaatgggttgggatgaagatcacatttatgcggtgaaaaacgcccaagccgttgaacgtgccggcggaaaagccgttgcccttcacggccgcacaagagtgcaaatgtatgaaggcactgcgaactgggatatcattaaagcagtgaagcaatccgtctccattcccgtcatcggaaacggtgatgtcaaaacgcctcaggacgcgaaacgcatgcttgaggaaacaggagttgacggcgtcatgatcggccgggccgcactcggcaacccgtggatgatttaccgtacggtgcagtaccttgaaaccggtgagttaaaagacgagccgaaagtccgtgaaaaaatgtcggtatgcaaactgcacttagaccgcctgattaagttaaaaggcgaaaatgtggcagtcagagaaatgagaaaacacgctgcctggtatctgaaaggtgtcagaggcaatgcgaatgtacgcaatgaaattaaccaatgtgagacgcgtgaagaatttgtgcagcttttagatgcatttaccgccgaagcagaggcaaaagagcttcaagatgcaaaagtaggttaatatacaccctctattgctgctcactgccagcttaccgctggcagtttttctgctttttcgtgaaatcaaaatgtaacggagtgataccaatgagtcaagaagagcaaaatcatgaggaattgaacgaccagctgcaagtcagacgagataaaatgaaccagctgagagaaaacggcattgaccctttcggcgaacgtttcgagagaacgcatcaatctcaacaaatcattgacgcctaccaggagctttctaaagaagaactggaagaaaaagcgatcgaagtgaccattgcaggccgtatgatgacaaagcgcggaaaagggaaagccggctttgcgcatctgcaggacttagaaggtcaaattcaaatttacgttagaaaagacagtgtcggcgaagaacaatatgaaatctttaaatcttcagacctcggagacgttatcggcatcaccgggaaagttttcaaaacaaacgtaggcgagctttctgtcaaagcgacatcttttgaactgctgacaaaagcactgcgtcctcttcctgataaatatcatgggttaaaagatgttgaacagcgttaccgccagcgctatctcgatctcatcgtaaaccctgacagcaaacaaacgtttatcacacgcagcaaaatcatccaagcgatgagaagatacttagatgaccatggatacttagaagttgaaacacctacgatgcacagcataccgggaggagcgtctgcacgcccgttcatcacgcaccataacgcgctcgacatgcctctttatatgcgtattgcgattgaactgcacctgaaacgcctgattgtcggcggattggaaaaagtctacgaaatcggccgcgtgttccgtaacgaaggtgtttctacacgccataaccctgaattcacgatgatcgagctgtatgaagcgtacgccgattataaagatattatgagtcttacggaaaacctcgtagcacatattgcgcaggaagtgcttggaagcaccacaatccagtacggcgaagagcagattgatctgaaacctgagtggaaacgactccacatggtagatgcggtcaaagaagcgacaggcgtagatttctggaatgagatgactgttgaagaagcgcgcggtcatgcaaaagagcatggtatcgagatcacaaactctatgacggtgggtcatatcatcaatgaattcttcgaacaaaaaattgaagaaacactcattcagcctacatttatttacggccaccctgtagagatttctcctcttgctaagaaaaatccggaggaccctcgctttacagaccgttttgagctgtttatcgtcggccgtgagcacgctaatgcgtttacggagctgaatgaccctattgaccagagggaacgctttgaagcgcaattaaaagaaagagaagaaggaaacgatgaagcgcatatgatggatgaagacttcgttgaagctcttgaatacggcatgccgccgaccgggggattgggtatcggtatcgaccgccttgtcatgctgttaacaaatgctccgtctatcagagacgttttattattccctcaaatgagacaacgctaataaaagggaaggcgccgttttctgcttatcgcagtacggcgcttttttagaaacaagccgctcgtaaaactttttgattttctttaaaaaaactattgcactattatttgtgaggtggtatattattattcgttgccgctaaacaaggcgctgacgaaaaaaagaaatttaaaaagttgttgacttcaagagattgataagatataataataaagtcgcttgaacgaaagacaaaatgatctttgaaaactaaacaagac

SEQ ID NO: 127 - DNA, 50181 bp, Bacillus velezensis FL50S
catttctttgacgatttcttccgtaaatgcgcctgaaacggtagatgtgccgatcaggatcgtcggcttggcctgtcgcaccgtctccgccagatcaattgatccgccttcaccgctgcggccgtactctttcacttcatcagcagggcgggcgtacggaacctgaaaatcacgcaagtccttcatatcatccgtcaacaatccgtttctgtcgatacaccaaaagcggctgtatgattcttcttcgcttaatccgttatgcaccatagcttcgcgcagctgctcagcaattccgataccggccgttcccgcgccgaagacgacgactttatgctcttttaaaggcacttttgatgctttcgcacacgctaaaacagctgcaagcgacaccgcgcctgttccttgaatgtcatcgttaaacgtacagactttatctttataccgttttaatatgccgcgggcgttagccgtgccgaaatcctcccaatgaagcagcgcattcgggaatgtttcccgggcaagcgagacatactcatcaataaagcggtcatatttctcgccgcgcactcttgaatgctggtttccgacatacagcgggtcatttaagaggctttcttgatttgtccccgcgtccaaaacgaccgcaagcactcgtgacggatcaattccggcggccgccgtatacaccgcgagttttccgacagaaatggcgatgccgccgacgccccagtcaccgattcccagaatgccctccgcatctgtcgcaacgatcaagtcaatgttttcattttttccgaactgctgaaatgcggcgcgcattccttcagggtcatctattgacaaatacagaccgcggggttttctgtactcgtggctgtaacgctggatcgcggtgccgacggtcggcgtatatacgatcggcagcatttcgcctaaatgatcatttaacagcctgtaaaataatgtttcattccgatcatggagagcggtcaagtacacatttttgctcagctcatcaggctgcgaactgaattgttcgtaggcccgcctcgcctgctcttcgattgtcaatactttcggcggcagaaatccctcgagcccgagttcctttctttcctcctgtgtaaaggccacccctttatttaaaaaaggcgtagaaagcacttctaatccgcgcagagttgttttgatttctccatctttcgtcacttgaaattgattcacctgtctcttcctttcaaagcaatttgtcttaggtttgcttttattcccgaaattcatacaggtaaatcatcgatccgcttattttctctcccgtttgacagatgcagccacttcgccgtcttctccccattttaccgctctgtaaatcgcgtcgtgatagaaaatcagccaggcgcctttttctgccgcgaacgtctgccatttctgcttttgcggaatggaggtcatcggataatcatcataggccagcacccataacggatttttatgcgcattcgtcggcatcaggtcggcaaaatgcacagccgtctccccgccgtcttctaagacgatgacactgtggccgtcgctgtggcctccggtgtggtgcatcgtaatgccttctgtcagctgatactcgttctcaaaggtttcgacctgatcttgtaccgcctcccaattttctctccaatatgtatttttcgatctgatattagggtttctcatttcgcgccactctgttgcagaagtgataatgcgggcattcgggaaaacagagacaagctcctctccgctgtattccgtcaagccgcatgcatggtcaaaatgaagatgggtcatcgccgcaatatgaatgtcctcacaggaaagcccgagttcacgaagagagtgttttaaattggattcctgtgttacaccgtaattccttttttgtttatcagaaaatttccctctgccgatacccgcgtcaaccaatatattcaggccgtttgttctgatcagaatcgggtctgttcttaattcaatctggtttttgtcatttacggggtattttctcgaccataaaggcttcgggacaacgccgaacatcgctccgccgtccatatgcgttacaccgccgtccagccatgttaatgaaatattcccaatattcaatgtctccatcttgatccctcctgatataatggtagcaaatggcggcataaaaaaacagactcccgcatcagagtctgtcttttgttctccattcaacttcggcccggtaaatcggctggccgagtgcggagaatttttcttcgtattctgtcataatattgcccttcggatcgctgttgtgcagatctaggctgacttctgtcagaagcaggccgtattcggaaaagcttttcagagagtattcgaataaaccgcggttatcggttttgaaatgaatctcacctgtttcgcccatcacttcttcgtattttttcaagaacgttttaaatgttaaacggcgcttttcgtgacggtttttcggccacgggtcagaaaagtttaaataaacgcgcttgatttctccccgttcaaatacgtcattcagtgtttccgcgtctatatttaacaaacggacattatgagccccgctgtcctttactttttggacggcagtgacgatgacgcttttaaacagctcaattccgatatagttgatatccggattctgcttggccattcctgaaatgaactgcccttttcccgtaccgacttcaatatggatcgggttgtcattgccaaagaccgtattccaccgccctttatactgggccggatcactgatggcgatgtcagcgttttctgccagaaaatcattcgcccaaggtttatggcgcattctcatatgattgacacctctatctataatttcgagtaacaacataccatgaaacataaagagccgcaagcgccttttaaaggcgccggccgcataaaaaaagaggctccccggtccggaacactcatgtgatgcataaaaccgcaccgctttgcacaatgtatgacacagaaaggatgtgtatatgaatcatgggcttaacaagcgaacatcaggtccggttattaaaggacatattggccgaccatcaattggattgctgcggcacggttgccgagtatgaacagctggagcgcgtcatcaaatcactgatggccaacaccgggcttgattcaaatataaaaaacgtgctcgaggatgtctaccgctacagccagtccggcatcacggccgattccatcgacacgcatattcaggagcaccaaaaccatttgtcccaatgggtggagcagatggattcgtactcctgactacttgacaatccgcttcatcagggcatgaagctcttccatggcatcatgatacgctttgtcgtttccttttgatttgtgccaggcgatgaaggtgatggtctccgataacatgtaccacgccatccgcagccgaagcccttccgtgagcttcatgccgtacatcccaagccagctgtcccacgctggctcttcgacgtaatgatacaataaagggccgagatccatggccggatcggctatcatggcgccgtcccaatctattaaatacagctggttgtcttcagacagaagccagttattatgattcacatcacaatggcaaacgactttttcaccgaattgcacctgatccacatgagcttccaaataagcaaggccttcctgaataagcggcgaaaattgccgcacggcaaagacggcctgcttcagctgcgacaaaagggcgcccggatcaagcggttcttttcccaatcttttcagcatgtcgagcaaagcttttgatgtgtggattttgcggagcagctcagccaccgggcgtccgctcatatcctttgccttcagctccctgcccgccatccaatgctgagccgtaatgacgtctccgttttccatccgttttgtccaaaccagcttcggaacaatgccttcggcggataacacggctaaaaagggcgagctattacgttttaaaaaaagctgctggccgttatgtttcgcataatatgcatctcctgtagctcctccggcggggaagatctcccaatcgctacctagtaattgtcccaaccagttcatatcaatgttcaacccatcatttcttaaaatattttagaataggcctccagcctttctctattggcggagcggcctgtcataaacaatttcatgagaataaaaaagacagctattgagagtctcatatgctaatcaatagccgtcctataaattttagcgctacagcacaaacttcgtcaagcaaaactagcaagaacacctgtgaattctgaagatttatgccgcgaaccgctctgttgccgtgaaacaattgacgggtttcatttgtttattatgtttttattttcaatggcgcaccgcccggcataagccgaaacggcgtcgttccgatcagctcgccgtcagcgtgaaacggaattttcccatctgtttcaaaaacgaattccttcccctttatcatcgtcactccgtccattttgatatgccggccgaagctcatcgcccataaaaaacgatacagcgaaaaaaaggacaggttttctgcaatgacaatatcaaaatagttttgacggggatttgctgaaggcgccgctttcatgccgcctccgtaataagggtgattagccgcaataacaaaccagacattgcggaattcacgtctctggccgtctgccgtgcaaacaaatctgaacggctgaaaccccgaggccgtatgtaaatgcgcgagcgggtaaatcacaaagccgagacgcaaaaaccgaagaacgcgcgaaaacggaaaattcgcggctgccttcaaaactgaggcatcgaagccgacagacaggtggttaataaaatagagtgattgcgctttgtcatgaaaaaagttgatgtttcccgcaaaaaatttccgtgtgagcgggcggtgcagacttttgatttcttggaggagcgccgacttcttaataccgagccctttggaaaagtcattgtacgaaccggcgggcacaaaggtcagctcaatctgatccgttcctttcagtccgttaatgacttcatgcatcgtcccgtcaccgccgatgacgaacagccgcttaagcttatgatcctgcatcattgaaatctgtcttgccagcacctccgcatgtccgggatgcccggtcaaaaaagagcggtggctgaccccgcgcctggtcagctctttttgaactgatttccagacacgccggccccgcccgcctcctgagaccggattaataataaaaaaccattgactcatcgtttgttttcacctgcttcatagatgaagagacagccggcaaacgtccgctttaatcaagccattcctgtctccggcttgaatcgctcaagccgtaagacaaaagagccttcgccgccttcagctggtggtgcttgatcggcgccgtatttttctgctgcttttccagccaccctgccgcagtccgtttatcagctatttccagcccgtacggcggctccgggtaatcaatataagacgttctgctgagcaaaagcttccgcacgggaatgtcggcctgcttttcttttacgatttgcgaaacgaccgagcccgtccggtgcaggctgagagacggattcaatacttggcgcgtgctgccggagcctctttcttcccaaaaacggtgttttgatccgatatatacactgtcctcttccgcttccataaaagcggcgcagaaaatctccagcggcgagatgatgataatgctcagttcgacggacgcctgctgaatttgcagaaccggatgatacatcacaaaataggaatcgggcagtttttgagccagcatttttaacatcctgtcccttttgaccgcctgcgaaagctcagacttttgagaaagcgtggagctcgcccattttaattgaaagtcatacagctgatctttgaaaaaaggcgcgagctcagacttttgagacggaagattcccgaacagcgcctcttctccctccggttcatcaaaccattggtgcctcttttcatttatatcggccgtattttcttcttttctcttttttaaggaaaattttttcctggccggcgcttgatcggtttccccgccggcagccgtttccgtttcttccgttatccggtcaaacgcttcaagaagcgcctcccagcgttctttcttcagccggataaactggttcatataatggtatggatcaagttcatatctggatatgcagtcgtgaattttgatgatctgtgccatgtgatttctccactccgaatatttgtttatgtcaattgaaactgtgcgatttcttcgtatttaggcgaccggtcaagatgggtctgaaacagggaaaacctgctgacggcactttgcaccctgccgctttcaaacggcacatcgtcagaaaacggccggtctcccgcccacttccgcgccatcgtcatatgagggtgatacggccgtttttccacttgaaaaccggctttcaaaacagcctgttttgttttttcccgcaaatcaaagagcagttcattccgttcgggctcaaggtgaagcactctcggctgtctgcggtcgccgaaaatatccagatgctgaaactgtacggtaaacggctgcgctgccgacgcagcatctgcgagcagagacgataatttcgcaagccgttcttcatccgcggctccgagaaaaatgagcgtaatatgatagtcatgcgggtgcacccattttttgaatgataacgccggctcctttttggctgcttcccaaatcggttcagcaatgtcagccggaatcggaatgccgataaaataatgcggcaatgaagctttcatacgaggatctccccctctttggttatggtgttattataaaacggataagcggagaggagaaccctgtccgctcattatgataggatattatgtaccgaacgttttatacagaaaggaatgagccggccttgaaaatcgtaaacagcacggcggagctgatcggcggcacaccgatcgtaaagctcaatcgccttcagccagaacatgcagcacaggtctatttaaaattagaatcgtttaacccgagcggcagtgtcaaagacagagcggcttacaatatgatcattgaagcggaaaacagcgggcatttaaaacccggctctgtcatcatcgaaccgacaagcggcaacacaggcatcggcctggcgatgaacgcggcggcgcgcggctacaaggcaatcctcgtcatgcctgacacgatgacgaaagaacgcatcaacctcctgaaagcgtacggcgcggaggttgtgttaacaccgggggcggaaagaatgcccggcagcatcaaaaaagcgaaagaactcgccgaacagattccgggaagttttatcccgatgcaattcgataacggcgcaaatccagatgcccaccgaaaaacgaccgccattgaaatctatcaggccgttcagcagctcaacagaccgctcggtgcttttgtggcaacggcgggaacgggcgggaccattaccggaaccggagaaacgctgaaagagcttttcccggatatgattgttcatgtcgccgagcctgcgggatctcccgtcctgtctggcggaaaacccggcgctcataagcttgtcgggacaagccccggatttattcccggcatactgaatcaggacgtttacgatgaaatcatgaaaatatctgatgaagatgcgtatacgacaacacgtcgtctggcccgggaagaaggcatactcgtcggcccgtcttcaggcgccgcctgcttcgccgccattgaaaccgccaaacgcctccctcccgaacagatcgtcatctgtatgacggccgatacgggagaacgttatttatccacggatttatggtcatttgaatgataaaaagggatgccgctttcggcgtccctttttattatcacttggcaagttcataaatggcttcggcatataaagccgttgacctgagaaggtcatcgatttcaatgtactcatccttttgatgcgcgctgtcaggccggccggggaacagcggaccgaacgcgacgcccgccgaaagggatctcgcatacgttcctccgccgattgaaatcagatccgctttctttcccgtctgtccttcgtaaaccttttgaagcgtctttactagcggatgatcggcagaaacgtggtgcggtttgctgtctttaaattcttcaagccggaattcttcagcagacgtaaaagcatcacggatgactttgctgtctgaagtgacgggataacggatgttgatgccgagttctccatcctcaccctttctgtatgtaaaggtgccgacattcaatgtaagctctccgctgatgtcatccctgcaatcaattttcagctttttgcctcgtgtatcatttaaaaaatagtcactgacggttttgacaaagtgctttccggctccatccagctctgttccgttaaggcattcagcaagctttaagccggcattgataccattatccggttccatcgcgtggcatgatttcccgtatacccgaagcgtcagttttccattttccgaaactgcttcaccttgtgtttttgactgctcaagccatttgctgaaatatgcgtgcacggcatcaataccgttcccttcaataaccgcttcagccgcatccggcaccatgttcaagcgcagtcctgaacggaatgacagaagcacgttttttgcgtctttgtcagaagcgttttttacaatgcgcagtgacgcatctataattcctttttccgcgttaatgatcggaaaatctgcgtcaggagcaaagccgatgtcaggcattttttcgtgtttgaagtagtgatccacgcatctccaatcactttcttcatccgtaccgatgatgattctcacgcgtttggataaaggaagctgcatgtctttgacgattttcagcgcataaaacgccgccattgtcggccctttatcatcaatggcgcctctggcatatatccggccgtccctgatatcggctgaaaacggatcgctcgtccagccgtctccgggcggaacgacatcgacgtggcacaaaacaccgacgatttcgtcacccgttccccattcaatatggcccgcatagccgtcaagattctttacggtgaagccttcttttttaccgaattccagcagtgacgccaggctggcattgacgccttctccaaacggccggccgggaccggctgttgattcgtccattacgctgttgatctgcaaaaacttctgcgtgtcacggatcagatcttctttgtttctgatgacttcaacttcccagttcatcacaaatcccctttcttgataaagacttgcaaaatgtcgataaaacgaataatatagatgatgttttgaaaaaatgttcgtcattggaggtacttatgtttcatctcgacaagcatcaaacgacaataaaaagagaaattaccgcgggattgaccacctttttcacaatggtgtatatcattgtcgtcaatccggtgatcctttccaatgcgggaattccgtttgaccaggtgttcaccgcgacgattatcgcttccattgtcggaactttatggatggctctcgctgcgaattttccgatcgccattgcccccggcatgggcttaaacgcgtatctcgcctttcacgttgtcggcacaggcagcggcattacgtatcagacggctttcagcgccgtttttatcgcgggagtcatctttattattttatcgttaacgcctttaagaaaacaacttatagaagcgattccggacaatttaaaatacggaattacgaccggcatcggcttatttatcgcttttatcggcttacgccaatccggaatcatcacggctgataaatccaatctggtcgcactcggcgatcttcattcgcccgccgtcattttaacgcttatcggacttatcatcagtatcgtgctgatggtgctgaatgtaaacggcgctctgttcatcggaatggcgctgaccgccgtcattgcctttttgaccggacagatccattttgcgaaagggttcatttcattcccgcgcctgccggagggtcttttgatcacaaatccgttcggtgccctcggggatgtcgtgcatcacggtctgtacgccgttgtgttttcttttcttctcgttacgatttttgacacaaccggcaccatgatcggtgtcgccgaacaggcgggattgatcaaaaacaatcagctgccgaatgccagaagagcgctgttggctgattcgacggctacgacggtcggaagcatcttcggcaccagcccgacgaccgcgttcgttgaatcttcagcaggtgtggccgccggcggaagaacaggtctgacggcgctgacgattgccgttatgtttgccgtttccatgtttttcagcccgcttgtcagcgtcttatcggaagtgtccgcgattacgtcaccggctctgattattgtcggcagcctgatgatgggtgctgtgtcgaatatccgctggaatgagcttgatgaagcgttcccggcctttctcgtcattttggcgatgcctttaacgtccagtatttcaaccggaatcgcactcggcttcatttcatatccgcttgttaaagcagctaagaaaaaatggcgcgaaatccatcctctagtcctcatcttcgccgtgctgttttttattcagctttttattttgaacggacattaagaaaaatccctttccttttcggaaagggatttttacatataaagaacggaaagaatcgcggcaatgagacaccaggcggaacagatgatttgaatgacggttaatgcattgtttcgcgcccggaaatagtcatcactgtctctcttgataccgcttaaaaccggtttatccgtgatccggtcaaataaaagtgacgcggcatagcggctgacgatcgcaaataaaataaggactgccggcttcactaagagcggaagaacgagaataagagccgtaaaagccgcggttaaaaggtaaagctgccggagatacccgccgtttcggatcagcactttaaaaaacaattctttccacgccgtatacgccgacctttttgtaaagatgtgctttgagccgggatataaaaacggcttgttccgccctttatttttaccattcgggagctgcacatcatggctgagcatcaaaactgaggcggcgagtgaaagcttccgcctgttctcctcaagcacttcttcctcaaaggctgataatgtctccgtccctttccaagtcaaaaaagcggaacagatgaacaatatacatcccgccggccaaagccaataccattcggcggcaaaggtgatcataaaaaacgcacccgccgtcagaaccatcactttcagccagcccgccgcctgattcccgaatgtccgcctgctgttttttctgtgccggtgcaccgctaatatcgcggtatggaagccgaacagacagcaaaacatacctgaatatgccggtaaggtacagtcaccgtactggcgccataagggaaataacaatacggcaagcgcaccccatttgataagggaaaggaacatcgaatacaaaagcgcgtaccgtttcagcttttgcatcagatgttttgcatgcaccaaaaacacgtgatccgcttccagcaaaaaggtatgaataaaacccgtgcacaacagcaaggcactgaatacatacagccagccccatcctaatactcctgccgctccattaagaagccccctgccgttcagccattcagcatattgataaacggcaaatgcggcagcgggaagaacgatgtacagcgcgaccgtccaatcaatgaccgtctgaaacaccttccattgataccgccaataatgaaacagcctttgaaaaaacaaagcccgcccggtcatcgctgactgctccgaaccgctgaataaaagcaatccagcagtgaacggctccccgttttttcctgaagctcctctaacgtgccttgaagaagcagagcgccctgatccagcaaataaaaccggtcgcagattttttccgccgtatccagaacatgcgtgcacatcaaaatccccgcgcctctttctttctcagcaatcagcatgtcggtaaacagcttcgttgagatcggatcaagtccgataaaaggctcatcaatgatgtaaatatccggcttcgccaaaaatgcctgtatgagcatcagcttttgctgcatcccttttgaaaaaccggaaggcaaatcatgttttacagacgtcagcgaaaactcttcaagcagccgccctgcccgctcacggcactcttccccttctataccccgcaatgacccggtcagctcgaggtgctcccaaagcgtcagttcatcgtaaaaactcggccgctccggtatgtaagcataagttgaatcattccactcaataccgccttcaatatcccgggacagcccgagaaccgcctttatcactgtacttttccccgcgccgttcgctccgattaaaccggcaatttcaccagcgttgactgacagagatacatcagaaatcaccttcggcctgtcagcataaccggcgcagacaatgtttgcattcaataattctcccaaacttctcactcccccgttttcatacggacatgtataaaaaaagtttcagtttccataatattaaaagcggtccggacatagtaatgcaccaaggctgcacccatttggaaaaaattatctgcgcttattcctagattcatgtcgtccatatcgtgtataatggaggcagttaaaagagaaaaaaacagaatgtcatcctttgttgcttattcgtacgaagttttagagtcgaaagttgtggtatatcaagtccatccgatcttatgatagggagtggttttttgaaaccttcaacaaatcgtatgctgactcggattaaatcagtttacatgttcatccaggaaaaaggccttgtgacaacacaggaactggttgatgaattcggcattacacctagaaccattcagcgagacttaaatgtgttagcatacaatgatcttgttcatagtcctagccgaggcaagtgggagacaacacgaaaaaaagtgaaaattacatcttaagcgaacaattacataaggcccttttcggcctgacatgctgcaaggcaaagcagcgtctttgccttgttttttgttcctctatataaaaagcccaaaacaaatctgttttgggcttttctgatatcgattacacttcagcgcctctcagcgtttcgagctcctcttcagtcagctcgcggaattctcccggtttaagatccgggtcaagagaaacagcccccatcgaaagccgcttcaaataagccacttcatttccgacagcctttgccatcagcttcacctgatgatatttgccttctgtaatggtcaagtgaatcaccgtttcatccgggttttctgtaatgatttcaacggctgccggcttcgtcttatagcctccttcaatgacgacgcctctttccagatgaacgatgtcttccgatgccagaggtgaagttaaccggacctcatatgttttaggcacatgctttttcggagaaagcaggcgatgagcgagctgcccgtcattggtgagaagcaaaaagccttccgtatccttatcaagacgtcccgccggaaacggttcaaatcgctgttcttcaggcgtcagcagatcaaccaccgtttgctggcggctgtcttctgtagcggacagcactccttgcggcttattcatcatgacataaataaattcacgatagtctgccggctctccgtataccgtgatgtcctgtttttccggatcgacatgggttttcacatctttcgccggctctccgtcaatcatgacagccccggccttgacgatttttttcacatcttttcttgagccgaatccgctgttggcaagcagcttatcaagtctcatcctgatcctctcctttaaaaagaaaagcccgcgataagcggactattcattatttctcaatgggcggaatgcctgcctctcctcaaaacgcggggcagacggtttccaaacattttctgtaaaaatccgattcggtacgcggcaaacatgtacaccgcaccgccgacagcggcgcagacaaagacgacaatcgccgcatgcacctggccgctttggtatgttacaaagaaactgagcagccattgagtcagcttgaccgcgactcccatcacgacggacaggactgcgattaaaatgacccgttttataagtaccgtatacgaatagcccgcatggcgcttaatcatgataaaaccgtacagaagagaagcgatataaccgagcgccgttgccaagatggccccgtctccctgaaacagcttgatcagcggcacgttcagcaccacttttataatgacgccgatgaaaaggctcacgacagcaaatttctgcttattaatcccttgcaggatcgcggcgtttacggtaaacagagaaaacagaatcgcgacaggcgcgtaccagaacaatatatcctgtccgatatccgggcgaagactttcagagccgtagaagaacgtataggccggacccgataacacggacatcccgacaacggcgggaataaccaaaaacagaataatttgcatcgtctggttaatctgctgattcaaaagcttataattcctgctcgtaaacgattcagtaatcgtcggaatcagcgtcagaccgaaagcggtcgccagagaaaccgggatcatcacaagcttcggcacataaagggtgacaatcgcaagcatgtcctggctgatatccttatggcccgccgcaatcatcgctttattaaacgtattcgtatcgatatatgaatacaaaggaatcgccagtccgacaaatacgtaaggagcggcataactgaaaagctcaatgaacatttttttataacttaagttcgcagacgggacgagattcggcttcatcgccagaagatcgcccttccgcttattccagtaaatataaaggacgacaagccctccgaatgatccgatcagcgccgcgaaagtcgcgtatccgactgcgatgacaaggccgccgttgatcactcttaaaatcaaatacgttgcgcccaataaaaagatgatccgggcaagctgctccacaacctgtgaaacggctgtgggccccatcatctgatgaccttggaaaaaaccgcgcacaaggctcataatcggcacgaccaaaagtgccagactgaccatccggatgacataaacgacgtggtcaatcgtaagtccgttgttactcgtgccgccgagagatgtttccgcaaaaaacggcgccgaaatataaagaattgaaaaagcgatcatcccggttacgagcataaccgacattcccgctctcagcatccgcctgctcgtctcatagtctcctttggagttatatttcgagacaaattttgaaaccgcggcgggaaatcccatcgtggcaatgtttaaaaacagtgtatattgattatatccgtattgaaacaaagctccgcccgtcgctccgaccatcgctccgaacgggatcagataaatcatccctaaaatccgcgatatataggtgccgagcgtcagcacgaacgtgccccttaacaatttgcttgacatgtttcctcatcaccattttctacgaagattcaacttttctattttaacacaactgggcaattagacggtaataattacagcgggaaactttttgggaaagctcttaaaaacaaaatacgtttaaggaatccccttctttcgctataatagcaggaagcggacatttccgcctattatacgtgaaaaagaaagttgttgatgaaatatgaaacattatgacgtaattgtaatcggcggcggcccgtccggtttaatggctgcgattgcggcaggcgaagaaggggcggacgtattattaatcgataaaggaaacaagctgggacggaagctggcgatttccggcggcgggcgctgcaacgtgaccaaccgcctccccgttgaagaaatcattaaacacatccccggcaacggccgctttttatacagcgcgttttccgaatttaataatgaagatatcatcgccttttttgaaaaactcggcattcagctgaaagaagaagaccacgggcgcatgttcccggtgacggacaaagcccaaagcgttgtcgatgcgcttttgaaccgattaaaacaactgaatgtcaccatccgcacaaatgaaaaaatcaaagaggtgcggtacgagaacggcaggacagcgggcattacgacaaacaatgacgaacacattaacgcagacgccgtcattatcgcggtcggcggaaaatcagtcccgcataccgggagcaccggagacggctatgcatgggcggaagcggccggtcataccgtgaccgaactctttccgacggaagtgccggttacgtcgtcagaaccgtttattaaacaaaaaacacttcaggggctgtcccttagaaacgcggccgtcagcgtcctgaataaaaaaggcaaacctattgtcacacacgtgatggacatgctgtttacccatttcggcttgtcaggccccgccattctccgctgcagccagtttgtcgtcaaagaactgaaaaagcagcccgatgtcaaattacgcatcgatctgtttcccggcatcaacgaggaagagttatttcaaaagatgcacaaggaactgaaagacgcaccgaaaaaagcgctcaaaaacgcgctgaagccgtggatgcaggaacggtatctgctttttcttctggaacggaacggtcttgatccgcagacaagctttacggaactgccgaaggatcaattcagggcttttgtcaaagactgcaaacaatttacggttgccgctgacggaacgctttctttggacaaagcgtttgtcacaggcggaggtgtttccgtaaaagagattgagccgaaacaaatggcgtctaaaaaaatggaaggcttatatttttgcggagaaatactcgacattcacggttataccgggggctacaatatcacttcagcctttgtcacggggcgtctcgccggtttgaatgcaggacgtttctcacgctcgctgtaaatggtttaaagcgcatttacctgagcgtccccgttgataattgaccaaaaacatgatacagttttctgcgttttgtttcacctgattgagggaacaggaagaaaggaatgatctgcaatcgtgcgaccatactaaaaaaatggcgtattgaaaaaaatagtcagagggtgagaacgtttgaagaagaacatctccagtgttttttggattgtgattgtcatcacagcagctgcggttttatggggggccatttctcctgacagcctgcagcaagtcactgatacggcacaaaaatttattacggattctttcggctggtattatctgctggtcgtttctatatttgtcggtttctgtctctttctcattgtgagtccgatcggcacaataaaactcggaaaacccggggaaaaaccggaattcggcttattatcatggtttgccatgcttttcagcgcgggcatgggaatcggtttggtattttacggggctgcggaaccgatcagccattacgccatcagctctccctcaggtgaaacagaaacaccccaagcatttcgtgatgcgctccggtacacgtttttccactgggggctgcacgcttgggccatctatgcggtcgtcgctttatgtatcgcttattttcaattcagaaaagacgcgcccggtttgatcagcagcacactgacaccgcttttgggcgataaagtaaacggcccgatcggcaaagcaattgactgtatcgcggtgtttgcgaccgttgtcggtgtggcgacaagcttagggctcggagcgactcagatcaacggcggtctgcattatttattcggcattccgaaaacattttccattcagctgatcctgatcgctgtcgtgaccgtgttatttttgatttctgcgtggagcggaatcggcaaagggattaaatacttaagcaataccaacatggcgctcgcgggtattttaatgatctttatgctcattgcaggcccgacggtgctgattatgaactcatttaccgattctatcggccaatacatccaaaatatcgtgcagatgagctttcgcttgtctccgaatgatccccaaaaacgcgaatggattaacagctggaccattttctattgggcctggtggatatcctggtcgccgtttgtcggcatttttatcgcccgtgtatcaaggggccggacgatccgggaatttttaatcggggtgttggtgacaccttgtatattggctttcttatggtttgcgattttcggtgtatccgcgatggatcttcagcagaaaggcgtattcaatgtcgcgggaatgtcaacggatacgatgctgttcggcgcactcagccactatccgctgacaatggtgacatccgtattaacgcttattctgattgctgtattctttattacatcagcggattcagcgacatttgtgcttggaatgcaaacgtcttacggctctttggacccgtcaaaccgggtgaaaatcatctggggcgtcatccagtccgccgtggcagctgtattattatattccggcggtctggccgcactgcaaaatacggctattctcgccgcggttccgttttcagtcgtgatccttctgatgatcgtgtctctgtacaagtcattagcgagcgaaagaaaaggaatcaaacaagcggagaaataccaaaaaccgagaagtccccgcgtcaaaaaagcataatgcataaaaaagcccggtatttcatccgggcttttttattttcggtataaaatcagagcggaaaaacaataaagctgctcaccttcaggatcacaggccgccgctaccgtatatttaatatcaacgagctgttcatcagaaatcccctttaaaaatgtattgacttctgtctgcagatccttttcatgctcctcatcaaaaacagctatcttcagcacatcaccctctcctttctctatcaatttattccggttcaattgaaatatgatagagaaaaacagattttcttttttactgatttttactaaaagtaaccaaaaatagttattgaaaacgcttactaatatatgataatatcattttaataataaccaggtcatttctgtttagtaaatatttagtaaaaaggagatgcgaaatggtccgtctcaaagatattgccttacaggcatctgtatccagcgcgacagtatcgagaattttgaataaggatgactctttggccgtgactgatgaaacaagagaaaaagttctgaggatcgccgatgagctgggctatcagccgtcggcaaaaaaacggaagaaccgcagccgcagcgattcagcgcccctgatcggcgttgtcagctgcctgtcaccggaagaagaacggcaggatccttatttttcagcgatccgaaaaggcattgaggaagaatgctttcggcaaaaagtttttatcacatcttctatccatctcggttcttttcaagagcatatgtttcacgaactggacggcgtgatcgtaatcggcagcctgcaagacgaggcgcttacgaatatcagcgccgctttcaggcacgcggtatttgttaacggcacccccgatcccgcccgctacgattccgtcagcgtggatttttatgccgcagcacagaaggcgatcgaacatcttctgtcgctcggttatcagcggctcggttatatcggcggccgggagcgggagcataccgtcatagacggtgtaaacagcaataaaacgattgaggataagcgtctgaccgctttcttacaaatggccggcgccgggccggagcatgtactgatcggcgaatacagcatgcacgaagggttccggctgatgaatgaagccatcaaaggcggaagtctccccgatgccttttttatcgcaagtgattcgatggctgtcggcgctttaaaagccttgcaggaagccggccttcaagtcccgcgcgatacggcaattgtcagcttcaacggaattgatgaggcagaatacgccagcacgccgttatcaacggtaaaagtatacacggaagagatgggccggacgggtgtcaaattgcttctcgaccgtttaagcggcagaaccgtcccgctggccgtgacgctccccacttcattgattgtcagacaaagctgcggctcacaagaaaggaggtgacatgtcccgcagcgtttatatcatatttaaaggaggaaaagatgaaacgcttactggctttgtttctttcttttacttgcatgatacttcccggctgctcggcagaacagagcggcgccggagaaaagcagaaaacattgacagtctattccacaatatcctcagacagcgaacgcgccgtattcagaaagttggctgattcattccaaaaagaacatccggacattcaagtaaacgttcatttcccaggcaatgactacgaaaatatgatgagggtcagaatggcagccggtgacatgcccgatcttttcgacacacacggctgggccaaaatccgctacggagaatataccgccgacctcagcggcatgtcttggacgaagcggctcgatccgaatttaaacagcatgctcaaagacgccaaaggcagaatatacgccttccctctgaatcaggcaaaggacggactggcctacaaccgcacaatgttggaaaaatacagaatcaaaccgccggaaacaatggatgattttatgaaggcactgagacagattaaagaaaaaagcggcggaacagtcacccccttctggtttgccggctatgagaaaagctcatttgcccaatattacgatcaattcgccgcaccgcttctcatcacagatcccgcacaccgttacaaaaaacagctgttaaacggaaccttccgctggacacacttcacctatttatctgacaaactgaaagagatgcaaaaggaaaacctgctcaatatagatgccgtgacggcaaaacggtcccagctcattgaactgatggcgcaaaacaaaatcgcctttacgctgcagggcggcaccctcggccaagacgtcgcccaaatcaatccgaaggtaaaagtcggcatcataccgaccccggccgtccacaagggagacgcgccggtttggatcggaggcgaacgttacacgctggcggcattcaaggattccccgcggcttgaagaagcgaaacagttcatcgcatttatggcccgtcccgagcatgcgaaatcaattgccgaagcgacctcgcttccggccggattagtgaatgtgcaaacggacattttctacgcaaatgactataagcgctatcagcatattaaggtgcagccttattttgaccgcctttatttgccgaacggaatgtgggatgtgatggggacagccgggcaggagctgacggccgatatcttaacccccgcggaagtttcggcgaaactcggcagggaatataagcggctccgtcttcaatctgattcacaaggagctgaaaaagaatgagtgatcttgcaagagaaacccaaggatttcagcatcaaaagccggtaaaacccgcgtcactgtggtggatgtacgttcccgctcttgccacggtttttattttcatgatttttccctttgtcaaaggcgcttttatcacattcacaaactggaacggcttctcacagacgtatcaatgggtgggggtcactcaatataaaaggctttttacagatccggacacgtggcttattgtgaaaaacactttgctttacggcatcggaagcactttttttcagaatatgctcggacttttatatgcgctgcttttgaatcagagcttaaaaatgaaggcgctcacaagaacgatcgtctacctgcccgtcattatcagtcctctgattatgggatacatttggtattttattttctcatatgacgggggtgcgctgaatgatgtactgggcgcactgggaatcggtcctgtcaacgccttggcaagccctgcggcaaacccgtggattatcgtcatgattaacacgtatcaatacgcaggcattgcgatgattgtatatttggcggggctgcaaagcattccgaaagattattatgaagctgcaaaaatggatggcgcgggaggtcttcagccgtttttcaccatcaccctgccattattgatgccggctgtcaccatcaacatggtcatcaatatcatcggcgggctgaagctgtttgatgtcattttcgctctgaccgcaggcgggccgggcaattcctctcaatcgatgtcgacgtttatgtatgatttatattttaaacggcaggatgcgggatatgccgccgcccaaggcgtgtttatgtccgttattattcttgtcatcagcttttcggctctcgtgtatttcaagcgaaaggagacggaaatgtcatgaaaacagcccgaatgcggatttttacgctgttggctgccgttatctcgtgcgttcatattgtccccttttatattttgctgaccacgtcattaaaagcaaaaggagactacagttcaaaatggtcgctgccatccgccttttcatttccgaattttcgtgaagcatgggagcgtgcctctctcgggcaatcctttctgaacacgatcattattacagccgtttccgccgccttgctaattttcatgggttcgcttgccgcatacccgctcgctagaagaaatacaaagctgaacaaaatcgtcttcggccttttgatttccatcatgattatcccgcctttgacttccatggttcctttatacaagatggtcgctgatgcggggctggtcaatacgcatgccgcagccattctcattaatacggctgcatatatgccgctgaccgttttcttatattcagggtttatccgctcttccattccgaaagaacttgaggaagccgccaagatggacggcgcgggattgatcaggactttttatacaatcgtgtttcctttgttgaaaccgattaccgcaacggtctgcattatttcctgcgtgtttatctggaacgattaccaatttgcgattttctttttacaagatcaaaaggtgcagacattgaccgtggccatggcggggttcttcggcgaaaacgcgaacaatcttcacttagtcgccgcagccgcaattatggcgatgctgccgatggtcgtattgtttttggcgcttcaaaaatattttatctcagggctgtcctccggggcggtcaaaggctgagaagaaaagggaggaatttctgttgaagaaaattacgtttatcggagcggggagcacgattttcgcaaaaaatgtattgggggactgtttactgactgaagcattaaacggatttgaattcgcgctttatgatattgacgctgtacggctgaaagaatctcagctcatgctggaaaacatgagagaccgctacaatccgagtatatccatcatctcctacgatgaccgaaaacaggcgcttacacacgccggctatgtgataaacgccattcaggtcggaggctataaacccgcgacggtcattgactttgacatcccgaagcggtacggtctccgccagacgattgccgataccgtcggaataggcggcattttccgttccctccgcaccatccccgttttatttgacattgcaaaagacatggaagaggtctgcccggatgcgtggctgttaaactatacaaatccgatggcctctctgaccggagcgatgctcagacatacaaatgtcaaaacggtcggcctgtgccacagcgtccaggtctgtaccaaagatctgttcgactcactcggcatggatcacgaaggtacggaagaacgcattgccggcatcaaccatatggcttggcttttggagattaaaaaagacggaattgatttatatccggaaattaaaagacgggcacgcgaaaaacaaaagacgaaacataaggacatggtgcggtttgagctgatggataaattcggctgctacgtgacggaatcatctgagcataatgccgaatatcacccgtattttataaaaagccggtatccggagctgatagatgaactccaaattccgcttgatgaatatccgaggagatgcgcggaacaaatcaaaaactgggaaacgatgagagacgggatcatcaacaaccaaaacctgacgcatgaacgctcgaaagaatacggttcgagaattatagaagcgatggagacgggccgtccgttcacattcggcggcaatgtgctgaataccgggctgataccgaatctgccggcgaaagcggtcgttgaagtgccgtgcgccgccgttaaaaaccaaattatgccgtgctattccggcgaacttccggagcagctcgcggcgctcaacagaacaaacatcaacacacagcttttaaccatcgaagcggccgttacattaaaaaaggaagccgtatatcaagcggccatgcttgatccgcatacgagcgccgagctttccatgaatgacatcatctctttgtgcgatgacttatttgaagcgcacaaagaccggcttccggcttatcactgatcattcgcgatccggtcccgggcgggctggatcgctttatatgttcagcaccagtttgaccgtctgtaaggtgtgtcctttaaaatcctcttcaaattcacataccctttgaaaccctttcgcttgataaaaggataaggcgatacggttctctttttctgcatggacataaagcttttttaccccgccggactgcctgatgcattctttaagaagtgccgtgcctatcccgcttccctggcaatccggatcaatatagatggcggtcagctccgcatttccgtctttttgaaccggggtggcatttgcaaaaccgagcactcgcccctcttcttccgccacaaagaataaagaatgcaagagccggcgttccatcatctcatcctgataggcggattcgagaaactgatcctgaatgtgtctgggaataatcccttcatacgtatgatgccagctgcgttctgcgacttgccggacctgtttgatatcgtttgttttcatcgcgcggatcatcggtttcacctgattcgcctcccgtttttttataaaaaaagaagaaaaagacgcacgtcccttttcttctttcacttcaaagcgttatttcttcggctttgtttcgccttcccactccagcatgccgccttcaacattaactgtacggaagccctgctcatgtaaatacatacaaacgttcatgcttctttttccggaacggcagataaatacatattccttgtccttgtctaacgcatccatcttctcagggatgtcccccatgcggatatgaacggcctccggaatcattccttcggcaacttcttcgtcttctctgacatcaatcagatacagctcttctcccgcttttaatttttcttccagtgcggctgtgctgatttcatttattttcaatgtgtgacactcccattcatctttatggtgttaagtataccaaagcccgcggtgcaatttctatgatagaggcctgataaaaaagcccctctctgtaggagaggggcttcgtccggtcagtttgccacgatattgacaagcttgcccggtacggcaataatttttcggatcgtttttccttcaagctgctcttttactttttcgtcagcttgtgcgagctgttctaacgctgctttatcagcatcagccggaaccattaatttcgcttttacttttccgttcagctggacgacgatttccacttcatcgtccaccagttttgattcgtcataagcaggccaagcctcgtatgcaatcgaaccttcgtggccgagtttttcccacagttcttccgccaaatgcggcgcaacaggagaaagcagcttcacaaaaccttcgatatattctctcggcagttcattcgctttgtaagcttcattaatgaacaccatcagctgagaaatgcccgtgttaaaacgaagggcttcgaagttttctgtcactttcatgaccgtttcatgatagacgcgctcaagagtttcgcccgcgccttctgtcactttacccgtcagttcgccgttttcctcgataaacaaacgccatacgcggtcaaggaagcggcgcgctccgtcaaggcctgattcagaccaggcgatagatgcgtcaagcggccccataaacatttcgtacaggcgaagcgtatctgctccgtgagacgccacaatttcatccggattgacgacgtttccgcgggatttactcattttttcattgttttccccgagaatcatcccttggttatacagcttttggaacggttctttcgtcggcacgacaccgatatcatagaggaatttatgccagaaacgagcgtacagaaggtgaagcacggcatgctccgctcctccgatgtaaatatcaacgggcagccatttatccagtttctcaggtgaagcgagctgatccggatttttcgggtcgataaagcggaggaaataccagcagcttcccgcccattgcggcatcgtgttcgtttctcttctgccttttctgcccgtttcaggatcagtgacttccacccactctttaatgttggcaagcggtgattcacctgttccgctcggtttgatctcatcggttttcggcagaatcagcggcagctcttccgccggaacggctgttgacgtgccgtcttcccaatgaatgaccggaatcggctcgccccaatagcgctggcggctgaacagccaatcacgcagacggtatgtcacttttttctcaccgtttttcgtttcttcaagccaggcgatcattttttcaatcgcttccgctttattcagtccgttcagaaagccggaattgacatgttctccgtctcccgtgtacgcttcttcttccgtgtttccgccttttacgacttctttgacaggcaggctgaacactttggcgaattcaaaatcacgttcgtcatgcgccggcacagccattacagcgcccgttccgtaagaggcgaggacataatccgctatccagatcggcagcttttccccgtttgcagggtttacggcatatgcacctgtgaagacgcccgtttttgttttcgcaagatccgtccgttccaggtcacttttcgcctgaacttctttaacataagcgtctaccgcttctttttgttcaggcgtcgtgatggcctccacaagctcatgctcaggagccagtacggcataagccgcgccgaacagcgtgtccggtcttgtcgtaaacaccgtaaacgtgtcatcagtgccgtcgatcgcgaaatgcacgtttgcgccttctgagcgtccgatccagttgcgctgcatgtctttaatgctttccggccagtcaagttcttctaaatcttcaagaagcctgtctgcataagcggtgattttcagcatccattgtctcatcgggcggcgttcaaccggatggccgccccgctcgcttttgccgtcaatgacttcttcgttcgcaagcaccgttccgagcgccgggcaccagttgaccggcacttcgtctacgtatgcgagccctttttcgtacagcttggtgaagatccactgcgtccacttgtaatagtccggatcagtcgtattgatttcacgatcccaatcataagaaaatccgagtgattggatctggcggcggaaattatctatattttgttttgtgaactcagccggatcattccccgtgtcaagcgcgtattgctcggcaggaagcccgaacgcgtcccatcccatcggatgaagcacattgtacccttgcatgcgtctcatgcgagaaaggatatcggttgccgtatagccttccggatgtccgacatgaaggccggctcctgaaggatacggaaacatgtcaagcgcgtaaaacttcggcttgtcattctcttcactgacggcgaacgttttatgatccaaccagtaattctgccatttcttttctattttttcgtgctgaaaactcaacgtaaaaacctccttctgattgaatacggcgtatgtagtccaagtattgacgggatgaggaagattatattcagattattctaaaactaaaaaaaactccctcatccctaaaagggacgagagatttttgtttcccgcggtaccaccctcgttagcgcggttttaagccgcactcacttgatacttttaacgcagttatgcgtcagcggttttgccgctgcaactctgaggcgagttcggaaacagacttgattgacttgcaccggccgtcaattctctgagtgcgaaatctgcttcttactgctcctcttcactgttcttatcgctaccgtaatcttacctgtattttatagaattctgttcataagtgcaagcaggtttgtatacaatgggaatgtacccggaacgggtcgtgagcggggatattattttgatggaggatttttttgctggtgtggttttgcttcggccgaatcactgttttgttctctgacaaaatcaaagctcctgagaacagcttctccgccgtagcctgcgattatggataagatgacgagttgaattcctgaatcggggtcagcggataagacaagtaagatggaagcagccattccgataaaaccatcttccaaaaaaccgagatagataaaccgctttgtcattctgggtttctccagcctgcctctctttttcacatgaccgagaacccccatgatgcctccaattacacaagcaattattacctgatgcagcatcttcatcaccttcctaaagcccttatttagtaaagcgacttcaggccatccagcccccttacgaatacgatgattttcgatatctacataccggcgattgagcaggaaagtaaaaagcttgtttcttccattatatgtgaacacatgatcggtaagcttgatgcattagattcatttttcacccagtgacaatgacctagtcacttacttagcgatgatgtgccttccccttatatattcagtgtatatgaggacaagcccgaatgacaaattgcaaacttcggctgcttgaatcagaacatatgttatgctacggttactgtagattcatttaaaaaggggagaaacaacggctgaaaaaagcgtgcagctttacggccaaaagggggttttacatggctgactcaaatgtatccggaaaactggagcagctggagcttatcaaaaaggcgcttgatcacgcacgcatcggcgtggtgattacagacccctctcttgaggacaatcccatcatatatacaaatcagggatttatggatatgacaggctacgcttccgaagagatattaggtaagaactgcagatttctgcaaagcaaagaaaccgaccgtcaacaagtcgcgaaaataagaaagagcttaaaccagaaagaaaagatcacggtgcggctgaaaaatgtcaaaaaagacggcaccccgttttggaatgaactcaacattgatcctctgtatgttgaagacaagctctattttgtcggttttcaaaaagacattacagagcagaaagaatacgaaaagctcctggaggattccctcacagaaatcacgacgctgtcaacaccgattgttccgatccgaaacggcatctccgccttgccgttagtgggaaacttaacggaagaacgatttgattcaattgtgacaactttgacggacatattaaccgcatctaaagatgattacttaattatagacttatcaggtttggccgaggtaaacgaacagacggcagaccagattttcaaattgcatcacctgcttaaattaatcggcacagaactgattatcaccgggatcaagccttccctcgccatgagaatgaatcagcttgatgcgagcttttcttcattaaagacgtatttaaacgttaaggacgccgtcaacgtgcttccggtcgtataaacaaaaaaatcccgccgaaacagcgggattttttatgtcgtcatcgcacttggatgttttgtttattaacggttttcaggcgtttgtcgtacagcaccgtcgctgcgatgctgacaacaagaagcaccatcaggatcaacagcagcacgctcatgccgtactgatcaaccagcacgccgccaaggagcggcccgatcattctgccgcccgtcgccgcactgttgacgaatccttggtaaaacccttctttccccttaggcgcaagctgattggcaatggtaggaacggcaggccagacaagcatttctccgacggttaaaatcaccattgcggtgaggtacatcggaaattgcttggcgctaagaagcacgccgaacgaaacgataaaaatacaaaagccgatgaccatctgcgtttttaacgcgccggaccattttttcagaacagctcctatgagaggctgtccggcgacaattaatattccgtttacggtccagagcacactgtataatgaaagcggcataccgatgctttgagtatgtgacgcaacggttgtggaccactgcgaataggcaatccacccgagaacatacccgccgctcaatatgagaagcgccgtaaatttcgttctgctgctgacaggctcgtagtccagaacagaaacctggctcgcatttccggttttgatatttcgaaacccgaaaaatacgataaggaaaaacagcacatacagcaaagcattggctaaaaacacgtacgtaaacgagtacgccgcaaccatcccgccgagtgccgagcccacggcgacacctgcgttctgagctacataaatcgcattaaaagctctccgcccgccttctttccataccgctcccgccatggcgtaactggccggaaacacgataccggaaccgaagccgacaatgatgagcagccaaatataaacgggccattggtgaaacagaacgagtccgagaagacttgccaatgtgatcataatgcccagcataatggatttgaatccgccgattttatcaaacaaaaatccgccgcataaattccccgccacactggccccggaattcagcatcagaacaatccccgcaacagtcagcgatttccctaaatgattatgaatatagatcgtattcagcggccacaaaaaagatgcgcccgtcacattgataaacattccgatgattaatatcttcaaagcgcgcggcataccgatccccctctctctataaaaaaccccatgaaaaaacggaaaccgcaagccgcggctccgtatcgatcacgttatcatagcacattcattctatcgccgcggaggtcttttttcaacatcagaatctgaaaaaaataatgccggaatgttgaaaaaattacaaatgattggattcgcaaaaacaggccggcttcatgctcttttcctcagcagccaaaacggaatatacagaatgaagaagctcaatatcaccgccgcttccattgatagaagataccacggccaaggtccgaaaacattcagaagcgaagcggtcttcggttttttcattaaatatagataatttgcattcagcacacgatcaataaaaaagacacacgccccgtacagatttacgatcagcaccgacacccacaacccgcgcgccgacggcctgtacctttctgaagcggccatgaatagacaggtaagaaaaacacagccgtgggagacgaaaaacacgatgtaccgaaaatgcgggaaagaatacgcccctaaatcaggtgttgccatcgcctgtacggcgctgcccaaaccggcaaaatagaggaaggcgaacagttttttgctttttgtcatgaccatcagcatcgccaaatagacggaaaggtcgctcagctgcagcggcagagctgtcttcagcgaccaggcatgatgacaaagcagccatatatgatagctgatctgcgacacggcaaggagaacgaatagtacatagcggatcatgcggctctggttgagctttttccggaatacgatcacgcccgcccccagcaatccgatgatcaacaatgtgaaaatgtgttccttggaaaaaagatgaaaggcccctgtttcagatttcactttaaaatacttctgcataaggctcccccgtgcgaaaaaatgacgtatgtctattcttttaaaaatcgctttcttctattcatacaaaaaaagcctccgcttatgcggaggctcctcaacttgttttacaaggcggattgaatgacctttttataatacagcaccgacagcatgccgaagatggagtacagcagcgtatacagcgccatgacgatgatcatcggcgtccacacttccgttccgaataaaaaccatcctgactgaacggcaaaatagctgtggaacagcccgagaacgagcggaatcccgaaatgatacgcctgcttccggcggatgcctttcagcagatctcccgttgtgaagccgagcttccgcaatatcgtataatcagccttctcatcctcacactcgcccatttgtttaaaataaaggatacagcctgaggtgatcagaaaggttaatcctaaaaacccgacaataaacatgatcagccccatgtttttcttttgcgtgtcagccgtttcaaattgtgaaagcgcaccgtctgaatagtgctgcgcctgaaacagaccatcagctttttggatgtcctcttctcgtttgagtgtaatgccgaaaaaccgatttgattttccctggatggacgggtcgatatctttctcgatccggtcgaatacctgctgcgtgacgataacggtcggcagccctccgcttgtaaatgtatatgacaggaggaagtcgttcttcaagcccttatacgccagcggtattttatccgttttgccgtttatatcaatggaacccgacgttttcaggtcgagaaatcttttcatcatatcattatatccggtaaacacggcttctccgtcagaaagctccgtcccttctgcgtctttctcgcttataatcggcagcgccaggctggacgggtcttgttgaaagcttttcatgtcgccgtttataatgttcttcatattgacaccggcttgaatggtcttgattgtttttactttgtgttcaattccgtttttcttcaataaagcggtaaaagagtcagtctccttttggttatcaaacgcaaagtccgcggctgtattttgctcagccgatttttccgcggagtagtacgagatatagcttaaagacagcaaaccgattgccagcgccgaaagagtcgtaataatcgtcagcaatacggcgtttgacttcatccggaacatgatggatgacaaagacagcacttcactgacattcagatacccgccttttgatttccggatgagatttgccagaaagctgaccgaacctttataaaacagataggttccgataatgaccgagccgagaataaacaccatggccgaaaacagttcattcatgctcgtaaaactgcctccgaataaatccgcggacacggcatagccggcgataatggccgcaataccgacaacgccgatcaacatctgcacccaagaaagccgtcttatgccgctttctgacgatgacgcggttttaaataaagacaaaatgctttgccgtttaataaataagtaattcatcatcataatcagcacgtaaattgccccgaacacaattaacgtctgaacgagcgccttgcttgaaaaaaacagtgagacagaggctttcacaccgactgtatgaaacagcatcatcatacataatttcgagagggaaaagccggcgaaaataccgatccaaatcgatccgaaatacaaaatgaaattttctgcgctgagtatgcggaaaatgtgcattttcgtcatcccgattaatcggaataagccgatttcccggccgcgccgtttaataaaaatggtgttggcgtataaaagaaataccgacacgatcgccacaagcagtacagaggcggcccggattgccgccgctccttttatggagcttttcatttcatcaagcgccggatcgtattgcatcgtgacaaacgcgaaataaagggcggcgctgaacaccagcgcaaaaacgtaaagataatagtttttcatattctttttcaggttctggaagatcaaatgatgaatactcatgcctgaaccccgcccaatacactttgcgttttcataatatcctgaaaaaagtccggtctgtcctgaccgcctttattcagctgcgtatacacacggccgtctttaatgaaaaccacacgtccggaatagctggcggcaaccggatcatgcgtcaccatcacaatggtggcgcggcgtttttgattcaggcggctgagtttattcaataaatccgtggcagcctttgaatcgagcgctccggtcggctcatcagcaaaaataatgcccggctcgtgaataacagctcttgcggcagacgtccgctgtttttgtccgccggaaatttcactcggatacttatgtctcaaatcatagatcccaagctcctctgccgtctcggcaaatcgcaggtccgcctctttcttagacattttcgtaatggataacggcaggagtatgttttccttcacggtcagcgtgtccaataaattataatcctgaaaaataaagccgagatgccgttttctgaattcggcaagctgtttttctttcatggatgtaatctccgtctcgttcagtttaatggtgcccgagctcactttatcaatggaggaaagcacattcaaaagggtcgttttccctgatcctgacgggcccataatgctgacgaattcccctttgtgaatctgaagatcaattcctttcagcacctcttgtttattcagcttgtttccgtagcttttttggatattgcctgcttctaaaatcatcacgttatgattctccttttacattggttatctttattttaaaaacagaagccgtttttttcgtttgattaagcgaacaaaagagaaaagcatgtgacacttttgtcacacgctgaacatgctgacggcatcgttctgttttggaaacaccaaggtaaaaatcgtgccgctttccggctcagagcgcacgctgatctggatgagaagcggagccgcggcttttcgagccaaatacaggcccatccccgttgacgcgtgatctcgcctcattcgcgtcgaggtaaatcctttttcaaaaatgcgcggaagatctttgggctcgatgccgatgccgcggtcttcgatatcgacatgcacccggccgttttgttcatagctttttacggtaatgtcatccgcttcactgtatttgacggcattgcttaacagctgcctgatgatgaaggaaagccattttccgtcactgtgaacgtccggtgaatcaagctgaatgtcaaacccgatccctttttgtatgcaccatgattgcaggtttttaatttctttgaaaacgagcggtctgagctgaatgcgctggaatgataaatcattttcaataaaggacaatcgtttctgatgaagctgctggtccaggagatggtgaatccgcagccattcatacagcaaaggggctttcagcggctgttcatcaaggcgctcgatcatgagatgcatcgctgtcagcggtgttttgacctcgtgaatccatgacatcagatcatccttttcatgctctgacgccgcctgaagatcaagtgagctttttcgtaattgctctgtctgcccttcaatgctttcttcaacgatagactcaaacggactgtcaggcgctttaagataagacatgtctaaattggcgtcccactctcttaagcttttataataggcggtctctttacgatagcggaacaagagaaatacaagaaacacaagaagcgacaggtaaacaaaatacagcaccgaaaaaaacggaatagacgcatcaatatatgccgcaaaaaggagcacagcctgctgcaaaagaaacatcgcgatccagctttttctttcgagcagaaatgatttaatcataaagaccgtcttcttcctttgcgatgtatccctgccccaccttggtttcaatcattttcccgatgcctaattgatcgagttttttccgcagccggttgacattcaccgtcagcgtattatcactgacgaaacgctcatcattccataggcttctgatgagttcttcccggctgacgattttatttttctgctcagccagcagttttaagatcagcatttcgtttttggtcagttcgaccgaaccgtttttacggctgaccgtgttggtttctgtgtcaatgaccgccccgcaccatcttttcatcagcgccggttctgtgccgtattggtgcacacggcggaacaccgcctgtattttcgcgattaacacatcaaagtgaaaaggcttctgaataaaatcatctgccccgagctgcatcgacatgaccatatccgcgggatgatcgcgcgaggacaaaaagagaatcggcacgtttgattgggagcgtatcattctgcaccaatgaaagccgtcaaatttcggcagctgtacatcaatgatcaccaaatcaggcttaatttcagtaaactcccggatgacccggctgaaatcctttattccgtgcaccgcaaatgaccagcccgttaatctctccttcatctcgtgaaacaaagtgttatcatcttctattaacaaaatgtgaaacatggtatccgtccttttctgatagatagaggaaaaaccggctgatgtccagccggcttttttcctttacagttctcttcttaatgcggtcagaacgttggtttttgtcgctttgcgggccggattcataccggaaatcaccgcgacccccgcacaaatgacaactgcgatcacaacgaggctgagcgggatgtaggagaaggtataatgaagatcttcagctccggtatttccccctaccgctttcaagataaccggcacagccagattgacggcaaaactcactccgtaagaaatgataatcccgatgacagaacctaatatcccgatataggcgctttccatcaggaacattctgcggatgatggacgggcttgcgccgatcgctttcataatcccgatttcctgcgttcgttccgtcaccgccatcgtcatcgtattgaaaataccgatggctgaaatcacgacggcgataaagccgacaaagatcagaccgattttaaagacgaggaaaaaggtgttgacgcccttcagctcggttgtgacagatctgacataaaagccgtcatccgtgaggtcatgggtaagctgatcgacatgatcgaatttgtccgcatacacattgatgcttttttccgcatttccattcttcagatccaagaatgtcgagaagtctttcttgaattgatcactcacaaaaatatttgtatcctccatccaatcttgggacggtttttttgtaattccgactactttgaagtcgtacgttttcgttttttcaacgtctccgtctttgtttgttttggagatgctcagctgtatcgttttattaagcaggtctttcgtatagccttttggttttttcacctccgacatgtcgccttggtgatcctttaactctttgtcgtaagcgtcagcctcttttttcgtcaataggttcttcgcaaaatcatagccgaccacgatttcattctctgtgcgggcgactcttccctgatcaagctccatattggctttgacttcatctttcatgtttgtcagcacaatggctgaatcttcatttgttcggtttcccaatgacgctttgttcggttcatacacttgtgttctctcaacgacagacttgacatttttatacttttccaagtctgatttcttcacggcttttccgttctcttggccgagcacattgatttccgtaacaatctgctggctcatcgtaatgtctgtaatcgttttttggatgccgaatccgacggaagccagcaccactaaaaacgcgcacgccattgtcgtcgccagcaccgtcatgaaaacacgcagccggtttttcttcatatttcttctgataaagtgaatctgatccttaaatctcaacagtaacgcccccttttaatacaccgtcatgcagctggaattttgaatgcgcgatcgaagcgacttcatcgtcatgcgtaatgatgacaaatgtaatcccgcgctcccggttcagctgctgaattaatgcaagcacctcaagttccgtttctgaatcgaggcttcccgtcggctcatcggctaaaataattgacggatttaaaatgagggctcttgcgatactgacacgctgctgctggccgcctgacagctcattcggataatgattcgcatgattttcaagtccgacccgtttcagcatatccgcgactttctgcttgcgttcagacggtttgacgccttttaaggcaagcggcatttcaacattttcataggttgtcagactcgggatgagctgaaagctttgaaaaataaagccgaaatgcccgaggcggaactgcgcccactctttttcattgaaacccgtcacatcagtgccgttaatgacgatacggccctttgtcggcgctatgtatcccgaaattaaattcagaagcgttgattttccggaaccgctccgcccgacgatacaggcaatttcccctttttcaacggtcaaagagacatccttcagtaccggaacctcactctctctgcctttcctgccgattttaaatgaatgatcgatatgctgtacctctatcacgtacaccactcccccttatatctgtttcgtttttttatagatgaagtaataactgatgaaaaacccgataatcgcaccgatgagcatgccgaatatgtaaccggtatacgaaccgttataagcatatccgcatacccccgcacttcccagcatactgagcgacatgacgagcacttgaatgatgcgttcaatgtgtttgctcaggataaaatgtccgcttcgttcattcggcattttcaggaaattcacatagccgaatagatagaaacaaaatcccattaatgcggagatgaacaatgcgtgtttcatgtaatacatccatgatgtatggatgtaagcggcaggcatgaaatagatcagaaatccgctccaagggaaatcaatatccggaacagcctgcctgccaaaaaggaactcggcgtttaacaggtaaatcgtcataaccacgatcggaaagacggaaaccgtgaacgctgtgatcagctgcgccgctaaattgcccgttatcgtgccggcagctgtcactaatgcgtagatcatcaagctgatgaccagtatccctgcgctgaatgattgaaaatgatggacagcgtcaggtttaagcgctagaaacaatatgtcggatactccgtaagaaacaaactgtgagccggctaacacggctgctcccaagaaaaacttcgtatgaaatatccggcttctcgaatacggaagactcagtgtaaacatcctttcagcccggcctgctcttatcagaaaaagccccataacaaccggcggaatgaaatgaagcccaatcaaattccgataattgctgtaatcgatgctgaatgtacaaactgaccccgggtacagctgaagtgcacgtaaacaatccttatagtgaaaatactcatttataattgccaaagggcctaagatagataagaaccccgctgtaagcagcagcagcgtctgccgctgcttccattctttataaagcaaaccgctaatcggcaccttgccttcctccaaactgctcattttcaaacggatctacatatgctttgactgcctgtaaaccgtaaaataactgataaaaaacccgataaccgcgccgaagataatgccggctaaatagccgaacatcgtgtctgtgaccccatatccgaaaacgccgaaacccataacggcaaaggcaatcaccaagatctgcaccggccggtccaattttctccaaagaaagaatctgccgttccgttcattcggatgtttcagaaagctgacgtaaccgatcagataaaagacaaggctcatcacaatcggaatgattaaaatcaaatctctttctctgatccagtcgttaaacacatatccaataggggttataaatataaaaagacgggattcgatataactgctgataaaagaaaattgatctccgacactaaaatcgaaaacgacctccaaattcgcggccggcagaccgatgagtaaaaaaggcagaatcgttacggtaaacgccgttaacagctgggcgaatatatgtcccgttattgctccggatgccattaacaaggcgtaagccataaaactgatgacaatcattccgattgaaaaatgatcaaaatcgtacgtatggctcggtttcagcaaagatatcagcaatgacgccgctccatagcctatcgcctgaggaacaacaatgactgccccgccgagccagaatttcgtctgaaagatttggcctctgctgtaaggcatgcttaacaaagcatccatcgttccctttgtccgttccaagcctaataagaagacagcaatgatgacactcacaacccagctgaaggaaagaggcgacccattcgtataattgacaacgaattcacaatcttgaagagctgggttattcaaacattcttgatatgttgagtagttgttataaaccataaaagggtttgccgccattaaaagaatgccgctgcataaaaacaaccactgattttttttccattctgtgtacaacaatccccgcggtatcattccggtcctcctctcttacacatgcttcgtttttttataaatcacaaaataactgaccaaaaatccgatcgctcctccgaccagcatcccggccacataccctgtcatcgtatgtcccgtcgagtaccccgccaggccaaaaccgagaacggcgatgatgatcaccacaatctgaatgggccggtcaagctgtctccagagaaaaaaacggccgttccgttccaccggctgcctgacatagcaaaagtacccgatggcataaaatacaatgctcatcactgccggaatgattaatatatacttgctggcagatacccagtccgtattaacatacatgatcggaatcagatattgaaacgaatcgtttaggtaagcattgactgatggcatcagctcatgcatgccgaccctgaagataacttccgcatttgtcagcggcaacgtaataatcaggtaaggcgctatcgacacggcaaacgccgttaacagctgggcaaaagtattccccgttaagcagcccgcgctcgcaaccaatgtaaaagccaaaacactcacaataatctctccgacgctgtaatggtggaagaaatatacgcgctcaggctttaacagaagaatgagcagctcagccagcccgtagccgatcacctgagcgccggtaatgaccgccgctccgagccaaaatttagtgtgaaacacctgagcgcgggaataaggcagactgaaaagcgcatcaatcgttcctttcgtacgttccagtccgaataagcaaaccgccaaaatcacagcgggcgcccagtttaagttcagcattccgctatccaaagaattcacataaaacttacaatatgctccgtgggtgtccagacagccttgataaaccagataggtatttaacacttcaaatggattgaccgccgctaaaaaaatgccgaccatcacaagaacagttcgattctgcacccattccctgtacagcaatcccctgtctaccatctccggttccctccaaacttcgcgatgaagacttcttctaagttcacaggaagttcgttccatactttcggctgcagctcttgcagaaagttctttttcttctcatcgttcttttgaatcagcaccgtataaaacacaccggcatggtcgagaatcggtatattttgttctctgatcttcaaggcgacgtcctcttcaaatgccatttggattttcatgtactcttccttcatatcatccaagtccatcacattcgtcagctgatttccttccaaaaacccgatccggttgcacattcgctcaatatcttctaaacggtgtgaggtaatcagaatgctcgtttcccgttcagctacttcatccaccataagctgcagcacgtcatgacgcgttacggcgtcaattccgtccgtcggttcatccaaaaggataagagccgggcgtgaagcaaaggcaaggacgagcgcaagctgttttttcaggcctgtggataattcacggtatttcttcgtttccggaatgccgtacctgttcatcagctcattggcgtaagtcacatcaaaattcggatagattctgcttacaatcgcaacaagctgtttatatgtatacttgtcataaaaaggattttcaacaggcatataaataatgttctgtttgactttcggatgacgctttatttccacctgattaaataaaaccgtcccttgatccggcagcagaatctgctgaatgagccggagcagtgttgttttccctgatccgttccgcccgagcagcccgaaaatttccccttttccgatggtgagcgaaatatccttgagcacttctttaccgtctatcgtttttgagagattccgcaattcaatcatgatcctttcctcctttcacatcagcgctgatttcctttatccattcctgcagcttctccagctcaactcccgcgtaatgggcatcgatgatgagctgtttcaattgctcttttatcatcgtcatcttcccttcaaccaatgtcgtttttgcattctccgatatatacgttcctcttcccctcagcgtttcaatgacaccatcgcgttcgagctccttgtacgctttgctgactgtgttcggattggcgataatgatcgttgccaattccctgacagaaggaagtttatcccccggcttcatgatcccttttaaacaaagctctttcaattgctgtatgatctgctcataaatcggagttgagcttctcggatcgatttgaatcatttacttcccttctttcttttacgagctgctctctttctttaaatgttctgccattgaaaaccgatgacgacaagaacgacaaacagactgctggccaaaaccgaagcggcgataataagaggcacatcttgttttacggatcttttgtttttcatgaaagttccccttccctatgcttaacatttatatgtcgatttcattttttgagtgttttatgtgtattacatcaagtagtacacgtaatacaataaacacactcaggcctattgtcaattctttttttaaaagaaataaaaaaaacccgccgggattccggcaggtttgctgaaccatttgaaacggcgcgatcagtaatcaaaattacgctgcaaaatcatgttgttttgcaaggtctgcagctgcaatctcattcggtaaagctgctctctttgctgatcattcgcagataatgacagcttgtttaattcattcaccgcgttttcaagcatcatttgcgcttcactgtactcattatcattataatgctcttgttttgaagcggtcataaattgctcattcgcaaattcatacgcctgttcgcttctttggagatgttcatctactgattgtcttgttgccattaaacagtcctcctattgataatgtcatatcaatagtatttcttattccaaattaattctcacaagaaatatcaggtaattcattcacaagacagagatggcataaaatacgattaaatgtaaaacttaatcaagacagaatgaagtctttataaaaatccttcattttagaacgctgtactttaccgcttgtagttttaaaaatttttctaacaggtataacttgatgtacatttaaacctaattgttttgttaattcttttttcaattccttctctgtcgttgtaatatcgtaactttttttacatttcagaaatatcacaaggtcttcttccgcttcctgttcattagtgaccccgcatgccacaacatttcctaattcaacatcctttacattctctgctaacctctctatgtcatgtgcataataattttggccattctttataatgatatcctttgtccttccagtaataaccagactgttattatgtataaagccaaggtctcctgtatctaaccagccatctgaagttatagcatctttagtagcagtttcattgttgtaataaccagacgttacgttttccccttttatttgcacataacctataaaatcatcttccagaacttcattattagaatcacatatacggatagaacaatgacgaacagcaggtccgacttcaacaaaagttactccctttttttcttcgactgtttctagaattttatgacctacttctaaagctctcctatcaagggttacaggaacaaaagggtttcctaatttcggcacactaacagcaactgtagcctcagctaaaccatatacagtatttagggtttcatattttaatccgaattgtttcatttcctctaaaaatctctggcacaaagaagtagaaattggttctgctccattagctaataatctaacacaagttaaatcccagttatagatttgattttttttgtagttatccaacaaaaacttatatccaaagttaggagagtataattgtgtaacacggtgttgatgtgttttcaataaccacaaagtcggtcttcggataaaaacggaggttggaattatatattgttgaatttttttatacgttgatgctaagtgaatagcaatgaggcccatatcatgagttaaaggcatccagcttagtgaggaatcggattccgatgtctcccaagcctcatttaacgctgatatattggtaataagatttttatgtgttaatattacaccttttggatttccagttgtaccagaagagaattgaataaaagcaatttcttctggttttggggaaattaattcacccacttcattagaattcttaatttcatctaaataaattgagcgttttacaattgatgaataagtttctgcatccgcaactttctcaaatgaatgtaatgttctttgatcagaaatacaataaggattattaagaatactccatatacgaagtattttttgtttatgctcttcattataccctacacttaaaggaataggtatgattccacctaatatgcacgcccaaaaaactttaataaattgttcattatcctcaatttgtataattagttcatctttctttttcaaaccctttttttgtaaaattcctagtacttttctggatttttcaaatatttgagcataagaaatatatacttcattatcggatccatttataaatgttattcctttatcatctcgattttcagcatcaactataaaatcataaactgttttatacacttaattttactcctctttctctaaaattaaagcagatttaaatttccctaataatccattcagaagagaatgaaatttagaagaattaagataatagtatgttttattttgatttctcgtactttcaactaaaccttgcaatgtcaaaattctcatatggtgtgaaatcgttgcgttggttaaatttagctgttcagcaatctcattagcatacatttttttatgactaagtaagattaatatcttgaacttacttttatccgataaaagcttcaaaaaatcaatgatgtgattaatctctgctttctctaatgtattttcaaatattttatcaactttataacccagtccaacataaatgttatcttcacttttcgtaatagttgcagtgcaaggtaaaagtgttggatatatattaatataattacaagataagtattccttaccttttaacgtactgattatcttttttggaaaatctatatttatgttttttaattgattcatccactcatctctgaatttaattaaattataaatcgcctcgttaagataaccattcaccaacattaatttattgcaaaattgatctacataagttttaggagatttcattaccttaaatatggtccacttgtattcgggctttatatttagattattaagtagctcgaataaactttccctatcatttaaatactgttgggtagatgtttcggttttaagatctccttgtaaataaattagagactctaaaatattttttcttatctcttcttctgtaactgcagacaaataatcaataatttcaaaaaaatctttcgtgtaaatttgtggtattttaaaaaatgttgtggctaaacaaaaaatatttgcattcctaacatctttgtagtcgcaaaagctgccaaaataaaaatttaaaaactcactatctaactcttttattcttttaagatcatctaataatacaaaatattcattatctaagtttatacccattttaatgctataatctttgaagaatccttcgtgttttaagaaaagcagagaagaaatcttatcaaaaaaatccgaaacactgtcactaatcaccaacttcacatctgaacacctcataaaataaaattaaaaatcataaattcttttttttacaaatgaaattgttgaaatatcttcatggccagggcatatgatagtattatcttcagtattattaattaaataagaaatggatttctttaaataatcttcatttcctgtttttttatcgggttttgcttttttatctttaaaaatagtatcacctgtaaataaaagtttgtcataaagcacgcatacgctacctgttgtatgccccggactgagaatgatcttgaggctaatatctccaatgtttaaaactgtatatttatctttaattaggatatcatcgctttcaaacttaaaactcttcccaagaagggcaagtccattatttatgatatctctcgcaaaatttatttctctttcatgaattatgaaattgcaattgaatttttcttttatttcatttgcagaataagtatgatcaaagtgagcatgtgtaagaacaatataatctattcgatttaatttcaatctttcacagaactctgttaaatattctaaactaactccagaatcaataaggatactcttatgacgattacaaattaaatacgtgtttgaattatttattccattcgagaatttataaactttacaattattcttttcaaaaattaattcatctgtttcattatttttttgtgatgcttcattaacgtaatctagaatttcatttaatgtttctttttctataaacacttctaatgaaatattgggtattttcgactctatttcatgatacatactaaccaagctcaaggaatctccacctacttggtaaatatcttgagaaaagtctattttatttaggccaaatagttttgcccatgtttcaactacaattttttcttgttcatttaaaataacatcgtcatttaagacaaagtctattttttcttcactataccagcaccgagttctcttaaaggtgaaaacaggcaatgaaacaacttgattatgttctttataatacatgtcccaatttatttcaccgcccataatataccttctgcaaatttgccttaaatcgtcttgagactcatctcctaaagacaattcttttacattagaggttatatcactaacgttaaaataaacttcactatctttaataattttatttccttgttgaatcttatttaatgcttcttttaatttttctaataaatcttccttacatgatgctattatagccactctatttgctaaatgatctcttctgcaattcaatgtatatccaatatcacttagtagcatcagattctcttcaagaagaaaattatataaatcacttaatagaaaagttaaagtatccacatcgtttgcagaaaatgtgaatatttgaggctctaaacaatcctcattatttggaatatttctctttttgttgtaatcagaaataatcatatggcaattagtgccgctcataccaaatgaacttatacatcctaacagcaatttttttttatgcaactctactttctcagtattaataaacacaggtgagttactaaaatctatatttttattaggagtattataatttatcgttggtggaaacatttgattttttaaagcaagcacgctttttaataatccagcagctccggacgcacttaataaatgacctatattattttttacagaccccataggcaaataattttttttgttaatttcggagaaagcacgattgattgcttctatctctattacatctccaattgcagttcctgttccatgcccttctataaacgaaatatcattgatatctatattggacttgttaatattttctgaaataaggttttcctgtccttcaatacttggagtagcaaccccaaaagaaaacccttgattactaacactacttccttctatcacagaataaatgttatcattatctcttaaagcactgaataaaggttttaaaataaatgtaataataccttctccaaatcctgtcccatctgagtcattgtcataagccctcgttctaaaagtactcgattcaataccgagtcttacttcatgctgaagaggaataagatttaagttacatccccctgcaatagccatctcacattcattatgaattatagctttacatgcttcgtgaactgctacaagagaggaggaacaagaagtatctagagtcatactaggtccttttaaatccaaataataagaaacccggctagcaatcattgaagggaggttattaacaatacttataggatttcgaatagatgaatcatatataaccttatcataattatatattgaatcactattactgctaccaacgtatacaccaatattacttccgttaacttttttttctgggtatcctgcatccaataatgcatgaatacttgactctagaaataatctttgacgagggtccatcaaagatgcttcttgataaggaatattaaaatatttgtaatcaaatttatccacatcgtttacaaaagccatttgctgatagtttatttttttcgtatctattcctttattttcaaaaaaataatcgcaatccttttttctctggctgtctatttctccaatacaatcaactttatttactaaattataccaaaaatctctgaagttattggatttaggtaatctcgagcttataccaattatagcgactttggtttctatttcttttttagtgaacttaatttcgtttttatctagttgttcaaaaacattaaacataaaaacatcactcacctttttagagcacctaaaaaaggtgccctttctacttttatattaaatcagaaataatatttatataaatattaaaaaacttttctactgatatttcccgcagtttattatttttaaatattaattcgagatttacattcttatcattaactaaataagtaaatataaattcataagattcgctaatattatttttgactttttgtttatctactatcaaaacattaatatgagcattatctctctcaaaacccaggttgctacgtaaagttattttggatactatctttctttttatattattctcctctatgttttttataaactcggttaaatcactatactcttctatatttattttttccaaatctatattactcatttttaaaatggatacataatattcatcgttttctataaagttactaaataaatataaaaatgtatttattactttgttatttacttcttctaagccgtttttaaccttaatgtccaactgtttttctaaaattatagtcttttcatttttattatcttttctgttagcaagaattttgggaggtaattttactgattttaattttaaattcttattctcctctttcatatctctaataaaatgtgataattcactaattttttgatacttgaataaatcaactatattcaaatctgaatattttttttctattttagtgtatacatttgaaagtgaaattgaattaccgcctaattcaaaaaagttg

SEQ ID NO: 128 - DNA, 50023 bp, Bacillus velezensis FL50S
tgtttttctgatgcgggaaattaacatagaagcctttaatgaatgaccgccgatttcaaagaaattttcatctataccgacgcgttccctgccaagtacagcttcccaaatctccgaaagttttttctccgtttcatttgtcggcgcttcatattttgtttcggacatttgagatatatcaggtcgaggaagtgcccgtctgtcaattttcccatttaccgtcaaaggcatgttatccatttgtttaaagtacgatggaaccatatattccggaagaaagtctctcagaaagtgctgcaattcaatctttgcgattttatgatttgaagtgtaataagcacagatatataaatcatcatcaccattatgatttactgttactgccgcttctttaatttctgtatgattgatcaatcgggcttctatctccccaagctcgattctaaaaccgcggattttgacttgctcgtcccgccgtccgataaactccacatcgccattttctaaataacgcactaagtctcctgttttataaagacgtgctgaaggatcattattgaaagggtgtgatataaaccgttccttcgttaaatcaggccgtcgccaatactctcgcgccagcccatctccgccaataaacagctcaccaggaataccaggcgctaccggttttaattgcgaatctaaaatgaatatttctgtaccagaaataggcctccctataggaagcgtactgcctttccaatcatgagggaccgggaaacaacaggtaaaggtcgttccctctgtcggcccatatccgttaattacttgtacctttccaagtgctaatactttttgaacatgcggaacggaaaccacatctccgcctaccaataattgctgaagcccttttaatgattctaactgctgattaactactagagaaaataaaccggccgtcagccaaagagtcgtaatgttatatttttttacagcttctgcaatatcatcagccgtcggtattcccggaggcattatagccagacatcccccattcaataaacagccccagatctcgaaggtagaagcgtcaaaagcggcagaagctaattgcagaaacgtttgattctcatcaaataccgcataatcagtctccttcaccagccgaatcacaccgcggttaacaatacttactcctttaggcagtcccgttgagcctgacgtatacatgacataagccaggtcatccaaggaaccttttatgccaatattagatccatccatcttttcaatttcttctttcataccatccaaacagattacgccgtccccgtgaggcgggagttgtgactgaatgctttcgtttgtaatcagcaactctacacctgaatcttcgattaagaatgatagtctttgcttcggatattgagggtctaacggcacataagcaccgcctgactttaatattgccagaatactaatatacaaatcaaaagagcgttctaaagcaattccgacaaggtctccccgttttactccgcactcctgaagataccgtgccagctggttcgcacggtgattaagttctgcgtaacacattgaagagttttctagtaccaaagcagtcttatccgaatattcatcagcctgctgctcaaacacctccgaaattgttccaattttcgaataattatcttcccagccaaagattttcttttgcttatttttttctttcaggaatctcatatctttcactctgatattttcaggagttatcatagcttcaaggatcatctgaaatcgcagtgacaaatcttttatcatattttgagaatagaggcattcgttatagtgtatggctgtctctatgtattgtttctggtttataaacgaaaataggatatgaatagcgggattttcttgattaagtatgtattcttgaatattttcaaggactatcatgacatcaaaaggaaggccagtcattttatcacttgttcgagaattattttgggggctttccaatgtctgttctacggtgaattcgactttatgtatgatctcttttaataggtcttcaccatgaacagcatttttaagagtcaaaatttcttgctcagaatcaatcgttctgttctttctgaaaacaggagtcttgattacaatattttgtctttctgtatattgatttattaacaaagtcagtgccgctgttaatacgacatgcagacgttcatccgatccattgcagcatacattcagcttatcgcttaattgctgtgacaatttatatgtaagatttttcattcttttttctttagaaggtttacttcccactaaaaaatgctcttcagtttttaactcaccaatactgtttttatctccctttatactttttgtcataacaaaaactccttcacttgatatcaaaattcaattcattcactgaattaaaacagcagaggctttcggtggatttttatgttaaactgcatcacaggcaataacgctcaccaataattgttgttgtagtctgacagtttatttatcggcagcaaaaaccattttttaatgatatagacccgtataaacactttttttaaaaaaaggataatgaagaagaactagccatctttaagaaatattatacaaatatttaagagttgtcaattagcggggaaaaacacctaagcacattaacccagtttttatttttcgtattaacataaaaaaaaaccgggacaaagtaacactcccgatttttcaatcaacaatttatctcaaggttttatttataatgtcagttatttcattcgaaaattgatgaataaaaaagtgatttccttcaaacgtataaaaattgcatttccctaaagtataatgtccccaattacatattaaatctgagcttatcgtcttgtcattaataccatgcaacactgttatatcacagtccataacagtcttattttcagaaataacatccttttccaacattttgaaatcacttcttaaaataggaagatataattgttgtaattccttgttatgtaacagttcttccgaagtcccgcccatatccatgattctttgcaaaaataaattatccggcaaagcatgaatcatcccctctgcttttttcgttttaggaatgccgcatccggaaaaaaatatgtgattgggcttcttctgctgcatttcagcaattttacaatataacttataaactaatcggcctcccatactgtggccgaataaagcataatcacactccctgatttgatcctttatcagatcatatatatcattaacagcctcatctaaatgttcataaaaatcttcgttaattcttgtacctcttccttttaactcaataggatgtattgttaaagagtcactcattaaccttctccatttatagtatattgcacttgatccccctgcatacggaagacaaaatatttttttcataattcacctcagaaattttgtaataacccgataaaaaaacaccctgaaaaggatgtttttactatctcattttatatatgaaatgctcttgaaactccgttgatgatgaggaagattcctattactcttaaaatgatccttgttgttctgttatcttttccaaaagcaacttgcccgattttaccgataaatacattcatgagtacacctataattaattcagccattccaaatagttcttccatacccaatttcctcacgtcctttttgatctgttaattttatccgattattgttgatttaattttcttttttaatctccctgcttatcaagatgaaagatacaataatacttaataagccgacacttgcaaaaattacgatcggaagccattcagttcctaaggtactcttactaaagataatgttgtttaaagactgtattgcccatgcttcgggtgtaaatttagaaataacctgcatatattttggagcaatttccaatgagaaaaaggaaccgcctatcatcccgcttactgcaattatgatcgatgcggcagaagtaaactgcttttggcttctcataaatggaaccataatcatcgtaatgcaggtcaatgcaaataaataaacagcgagcataacagcgatggcaaagatgttatgacctatgctgatcttgagtaagtattttcccgcaagtattataacgattatatgaatgattccggaaatataagtagcagccattttggataaaacatattttgtatagtttataggcgtacttagtaatcggctgaaagtattattctctttttcatcaataagtgttcttaacccttgaataacaacaaaccaaataaacattacaagaaaaccaattaatctcacggtcgcattatcctgagtatgtttaccctggcttaatgttttgtcattcacttctattcctgaattgtttttcaatttcttgaaaatgttcttttctatatcttttgagtccgtatgcaactgtgcagacatatattgcgaatctttaactacctttttaagagttcccgcctcatttgtgaccagctgctctaacaatgttccgctgccgttctcatagttttggatgattttcatttttatcttgtgattgtccgccaattcctttccaaaacctttttcaataacgaccccaaaaggaatatcctgatcatcgacttttttctttatttcattttccgttagctttataactttaatatttttatgctcttttatcatttcaatgagctttgcagcatagttgcttttatcagcattggctatatacaagttctctttgctatccgtatcttgggaaaaagagaacaaaaatgtaaggattaacggcactgaaatagttgcaaaaattgctaatctatttcggagcatcagcttcagctgatgtttaatcatggcaatcaattgcactactacgccaccttcttcctgttgaataccataatattaataaagacaaagatgagaccaataccaattagctcaagcaaatcaatatacatgccgctaaggccaatattctgtttgacttttaaataagagtttattgccttaccgttcggtatgatctcttggacaaccctcaagctatcaggcagtccgttcttaggaataaaactgcctcccaaaaaactaaaaatataaagaaccggagaagccatactggacaccgccacgtggtccttagcggtaaaaccccaaaacaatacaatgctgcctatagcaaatgcgtatactaccgtaataacaaaaatatcaaacaagttgccccagttcattcggaatacgacccagcttatcagaataacagcagtcatctgcattaagatcgcaaaaataatacctgtcaactttccaagcacatactgaatatttaaagtcggtgtagatttaattctgaacagcgtattattctgccgctcatcaacaatgctatgaacaagcacaaaagccgtcataatggaaaacataacaaccattgcaattgaataatactgcatggaatcgacaggaaccgcatttttatttgtcgctgcttttgggatatcagcggagatcccgtcattatcggccaaatcgttcatcattttttctattttttcttttggtacgctgccgccggggctgatatgttttattacttcttgttgctcagcactcattgttttcacgcttttcgtaaagccctccaaaacagcctgaacaatatttttatctatggtcttattattatctccaattaaatcgatatttgttttcccgttgttcataacggctttcgtaaagtgttccggtacatagataaaagctgcagcctttccttctttaactaatttttcaccgtcattgtagctctcagcttcttttaaatgaatgatatctttgagatctcctttcttaaaaactttatcctttaagacatcacctaaagaaacactctctcctgaatctgctgagtaaaaagctacatcaaatgcttcgatttttgaatctgaattactgaacacactgcccaatatgaggattagcagtgatggaaacagcatcagctttaaataaaatgacttattttttgttaacagcttaaaatcaagaaaaaataagttgaataattttctcaagatagcctcctcctactaatctcttaggtttttccctgtaatttgaaggaaaatgctttccaaatttacttcctcgtacttaaagctagtgaggtcgatccccagatttttgatatcatctacaatttcaatgatgtttctttccttcgtcgatacaagcattgaaatttgtttatgatctaccgtcactttatcaattcctgtaatgctgtttatccggctgagtgcctcttcatcagcacccttaaaagtaacagttaaagtgtcacaagcatttaagttttccttgagttcttctttcgttcctaaagcaataagagatccatgatcaacaattgccaccttctcgcaaagatactctacttcttccatatagtggctggtataaataacagtcattcctttttctttattcagcctttttactgtttcaagaatatgatttcttgattgcggatcaattcctacagtaggctcatcaagaattaataatttaggattattcattaacgccacgcctatgttgacccggcgtttcattcccccggaaaactctgatacattttgattttttttatctgtcagttcaataatctccagaacctcatcagttctttcttttagctttttccctttcagcccgtaaaggcttccgaagaagttcaagttatctttggcgcttaacgtttcatataaagctaaatcctgtggaacaacccccattattttttttatctcaataggtttttccttaagtgatttattatctactttaattgtcccgctggtaggtgcaagaacagtgctaatcatagaaaccattgttgatttgccggcaccgttaggacccaatagtccgaatacttctccatcttctacagtcagcgaaatattattaactgccgtaaagtcatcatattttttggtaagtttttttaattcaagcataattaaaacacccctcgtggtatttcggttcttttattttaacctgaatggaatatttttagaatttactatagtactcatttaccttattactttagttacgaatcgcatcgttactttagtcatatacggaaggtgtaagtccggatatattcagaagaaaatggaggaaaggaatttgatgaaattcctttctgattgaaggaaaaaagttgaatcacatatgcttttgtaaatataagctaagctccgttcggttgttcatttgaagtttttccagtattcttgatacataatttttgactgtgccttcagtaataaacagtgcttcgcttatagctttgttgcttttcccttccataatctgtttagcgacttctttttctctgggagtaagcaattgcaccagctgttccttttcattattttcttgaacaagctctttattatgttctaccgaatttagagcctttacaacttttagcgttaccttaggatttaacagaatattgccttcacatgctgttttgatggaatcaataatttcttgtgaatcagaatctttcagtatgtaaccatcagcaccgcttttcagtccagtaaaaatgtattcactatcgttaaaggttgtcaggataatcactttaatatccggatatctctctttaactagctttgttgcttcaatgccgtccattacgggcattcttatatccattaaaatgatttcaggccttatctgttttagcaaatctaataaatgttcaccattagaagcttcgcctacaatattaatttcctcgtgcagactcagaatcattttaagcccttccctgacaatttgctgatcatccacaatgataatatccatatcaatacctcctcacattccgattaaagatctgctatctcggggattacggcttccacagtaaatcctgaatctagccctgaataaaaatcaacctctcctccaagtgcggcaaatcttttttctattccgtttattccatttgacttattaatttcagaacatcctgttccgttatcagttatcgatatagagattttttcaaaagacttacgtatttttattgaaaaaaacgtagcatttccatgttttatcccgttggttatagactcttgtactgttttatagagacaattcttgatatctggatcagctgactctactttattgtccatatcaagctcgaattttatttcatttgtttgctgaaaattttcaaaaatctcattgatcgatttcagaagccctttttgaggagcagggtcattgagcaaagcgacagcttctctcaggttaataatacactccttcgataaatcatgtgacttattgatgacttgtttagcctcgccgggatttttacttactattttatcggcgaattcaagattcattgttaatgcgatcaaataatgccccagggaatcatgaagctcttgtgcaattcttgtccgctctttagaaatagttaactcttgaattttttgagaataattcttaagtttagtgtttacactttgtaattctttatttaatgtttgtatttttgctttttcgagcagtacgtttctaaacagataaataatagccatgatcactaaataggacatcaatatatctttcccgctggtccctgctgctttaagagctgtaaaaaaaataataaaatgcagacttactacagtccagggcagtttacgagttgttacaataatctcgatcagtaaaaaaatattatatatttgagaaccgagacagttaattttaaacaataaaatgcctgataaaaggttacttactaaaaaagatgcataatatctaaaagaatactgaccgcttaggtattttaatctgatatgatcgttgacgactaaaaaaatggtgataatcagcaggtaagcggattccgaagccgtaaaagttggcgttttaaaaatagaactgataatagaatataaggaaaaacaaataatggttttctctatgagcactcttgtactaattgaagaaagatttttcataataatccttcccgagacaacttgatataaattatattatacatatattgagaaatcataaagctacaacctccacgttcagcacatcatacagctcatcaagcgaatgaatttcatacgtcgggataatcccggactcatttgctttctttccgggattaaaccagcacgtatccattcccgccatctgaccgccttttatgtccgcgctcaatgaatcgccgataataagcccgtgcccggcagaaaaaccgggaattctcgcaaatacataatcaaagtattccttcatcggcttttgaaaacccgtgtcctcagatacaaacacatctttaaaaaacggatacagaccggagtcgcccagccgcttatattgtgatcttgagacgccgttcgtcacgatgtataaatcaaataaaggactcagccgttcaatcagctcataagctccgtctatcatctggtgcccttcttctaagtattggcggtacgcctgattcatcagcacgccgtcggcttcaaggccgtattctttaaacaaaagggcaaaccgtgtattcaccacttcatcgcgggtcatttccccctcttcaaacgccttccacagcccttgatttaacgctttataacgggcttccacctctgccgtcagctccagctttgaaccttggaacaatttttgaagagcatcggtttctgaagcggtaaaatccagcagcgtattgtctatatcaaataataacgtacggtaatgactcatcgatgtttcccccggttctgctttttttaaccagtataccactcgcggacaagccgaaaaagacacccctgtaagagaggtgtctttttgaattatacagcgtcttctattttcgatttttcaccaggcatgcgcttgccgataccgaacgcataatagctgaccgtcacaatcgccaggaaaatcaccccgacaaccaaagaaatccgcgtatctttgttaaaccacatgccgatcaataccatgagtaagaaagcgatcgtcaaatagtttgtaaacggcgcaaaaggcattttaaacggatgcttatcaagcccagcgcctttcgctcttctgaaaccgagatggctgatcaaaatgacgaaccacggaatcattcccggcagcacactcgcgctgtacacataaacaaagattttcggaggcgcgatgtagttcagcacgacaccgatcacaagtccgattaataccgcaagcgtaccgaatatcggcacaccgctcgaagaaactttcttaaagaatttcggtgcctgtccgttcacgcctaacgtataaagcatacgtcccgcactgaatatcccgctgttgcatccggacatcgcagcggtaatcaccacaaagttaatcaaaccggccgccgccgtaatcccgactttcgcaaatgtcgaaacaaacggactaccgagtgagtgaagctcattccacggatatacggtaacgattacgaaaatcgcaccgatgtaaaaaatcaaaatccgccagataatactctgaatcgcgcttcgcagcgttttttgcgggtccttcgcttcccctgccgtaattccgatcagctcgaccccttgataggccgcaacaaccaaagacaaagcaaagaaaaatcctgaaaaaccatttgtaaagaaaccgccgtgcgaccataaattagataatccgatcgcatgccctccgttaccgaaaccgaagaaaataattccgattccggccacaatcatcagaataatggtgacgattttgatcatggcaaaccaaaattcaaactcaccgaaagattttactgaaattaaattcgccgcaccgagaatggccatggcgataatgccgggaatccatgccggcagatcaggaaaccaatatttcatatacgaaccgacggcgataatttcagacatcccgacgatcacccattgaaaccagttgctccacgccgtcatatagccggctaacggatgtatatacttatggccgaatgtcgcaaacgaccctgtactcggctctacatagagcatttcgcccatcgcacgcatgataaaaaagataaagatacccgagatcgcataagccagcaggacagacggcccggtccatccgatcgtgctggatgaccccatgaataaaccgacaccgatcgtgccgcccagcgcaatcatctgtatatgacgagcgcctaagcctctctttaattctttgtttgccacttcgcttcctcctcttaacagctctgatatatgtgaaataatgaagcagaaggtgcacctgttgaacctaactcaatcttcatttcccgcaatattggaaatattctatcttcctatcgttatataatctccaatttccttattccatcataataaattttcgtggaaaatacaattgtttttttcaggcaaacaccttgcactctgaaccaacggactaaaaataaagcgctttcatttttattgaattgtgaatattgagataataaatgccgcagcctccgagaaacattatttcccaggagaaacgttttccgccccctatccaatattatttttgctaagcagaatggcgtaaagccttactctcttccattctcccttgtatacgccataatccgcttaacccggcaaaaatcatgcattaatcgataaatgcctcattcagccgcagcaaaagccggccgaacatttctttttcatcgccggaccaatcgtcaagcatacgatgataccgctcaagacgcatctttttatcagcttttaacctctgtttgccaagcttcgtaatcgcaaacagactgacccgcccgtcagaaggatcggaaaaacgctggatcagctctttcgactccaaggccgctgcctggcgtgataatgtggaaatatccagcttaaatgattcggccaattccttcacacgcgccggcccgaattcatccagctgccgtaataacaaatacgcagccctttccagatgtccgattttacggtcggagttatcaagataaacagctctcctgatgaaagtggtgagttcatattcaattaattcaatcggatcttgttttgacaaacgcctcactccttacattgacaacagcaacattagttgtataatacaaacatatgcacatttactcagaaaacatatagaaatattttgcatacatatatttgtatagtacaaatatatgtgccaaaagtaaagaaacttatagaaacatcaagaaagggggaagctgctcttctccaaagaacagcatcgttgtgaaagtcatacgcatcatcttgcaaatcattattttattcgcattttcctttatcgggggagccgttcagcagttctttcacctgcccattcccggaagcatcatcggtttgatcctgctgatcatatgtttatcggttaagatcattcccgtcaaaatgattgaagacggagccggatttttgctgtcttttcttccgctgttattcattccggccatgacgggcgtcatcaattacccgtcactgttttccgccagcggggctgctctgtttctgatcatcgtgctgagcaccatcgtcacaatgatcgccgcagggtacgccagccagctgttagagcataaagccaatcagagaaaggagaaaaagaagtgcagcaagcatgtatcgcaatccttataattttgttcacggccgccgcctatctggctatggtgaaattatatgtgcgctttccatacccctttctcataccggttttgacgactacgattttcattatcgccgtgctgcttgtttttcatattccgtataaagactatatgatcggcggacaatggatcaattcactgctcggccccgctgtggtggctttggcatacccgctttataagcagcgccgggtgttaatcaagtatatgtttccgatcatcggcggcgtgttggccggtttattctccggaatggtcagcggcctgctatttgcagagctgttcggcatcagccggagtttgattttgtcaattatcccaaaatcaattacgacgcctgtcgccatacagattgcgtccggtatcggcggtgtcccttccatgacagtcgtattcgtcatgatcgcagggttttccggcgttatcttaggaccgctgcttctcaagtggatccgcatccgcagctcactcgggaaaggaattgcattcgggagcgcttcccatgcgctcggcacctcaaaagcaatggagtacggagaattaacggtctccatgagttctgtttccatgacgctctgcgccgtgttagggtcggtcttcggccccgtcgtagcatggatgtttcaaatttaaagccggcggttctccgtcagcttttttcatgtgcggatcacttcatttccttccattattatgtttcatttgtaagcataatggtaaagtagaaaacaaggagggatttaatgatgactgggacaattccgcaaaagaaactgcttgatgggacaagcattcccgcgatcggcttcggtacatacgctcttaatggaaacaatggcgttcatgccattaacagcgccattgatatcggctaccgtctgattgataccgcttataactatgaaaatgaagggacggtcggagaagccatccgcagaagctctgttccgagagaacagctatacgtgacgtccaagctgcccgggcgctaccatgactatgacaaagctgtacaaaccatccaagaatctttataccgcgccggtctggactactatgacctgtatctcgtccattggccgaatccgaaacaagaccgctacacggaagcatggcaggcactgattgatgcgaaaaaatggggcctgatccgatccatcggcgtctgcaatttcctgcctgagcacatcgaacggctcgaacgtgaaaccggcgtaaagccaggcatcaaccaaattgaactgcatcccgcttttaatcagcagcagcagcgccaatggcacgaagaacagggcatcgtgacagaatcatggagtccgttatcccgcgccggcgaagtattgaacgatcaaaaactcggacagattgcggacaaatacggcaaaaccatttctcaagtcattttgcgctggcatatccagctgggcgccatcccgattccaaaatcagcatcgcccgagcgccagcttgaaaacatctctgtttttgatttctcccttgatgaaaacgacatgagcatcatcgactcgcttacccgccccgacggacgcataaacggccaagacccggcggagtatgaggagttttaagaaaacacataaagaaaagctgacggcatcattcgtcagcttttttctgaatctttatctagttctcgctaacaaacacaatgtacgatttcaatatggcttaaaggcctatcaattttaacactcagtgttagagccataaggagtacacctttcatctattatggctaacactgaatcctaaatggaatatttattttaagtactcaactcggctatttttagatacgtttagtccttattttttctttaagacggctgcaaaaaactctccgttatttttatattcctcgccattgacatctgcatagactttttcaaggttaaaccctgcttcattcacttctttttctaaattttcaatgctaaaatgctggttccaataattataattcactaatttcccatcgtcaaaaatcaaaacattttttgccaaagtaacattatcaggatatttaattgcagcgtataaggtcaaatgttccttatccgatatcagactgtccttttttgataggaaccacattaaattctcttcaaatttttcataactcttctctgataagacatctaatagaactaatcctccaggttttaaaccgcgatagatgttgttaagtatttttcttctgttggtcggactaaaaacaccatagatttgataaatgagcagagctacatcaaattcactttcgatttcgagattcgtaatatcttcaatcttataatctatttgtaaattcattttatccgcttcactaatagcataatcgattgattttttattataatctacaccagtcacgttgtagccttttaatgctaaattttgagaatagagccccgggccacatcctaagtcaataattttattattacattctattggtgctatttttgtaataaaatccacagtctcatcaacaaatgagctccctttgctgccgccgggtatattctcatcaaaatgtgatttcaaaacaagttcagctctatctggatcaagccatacctcttgtgtgccttcttcaaatggttcagggttttttgccaattctaataactttttaattgttgtcaccttctatagttttttcatgatttgttaattataattaagaactcttgggtgctgattttaactacaagcacccaagaaatgataaacttaaggcttctccgacagtccaatacagtgttcatcatttatacttcattaatatttaatgaagcaagattgttttaacaatgattacttactgaagaaacaaaaccgctagttgttgttactgtccatgtcgttgtaattgtcgcatccacagctatacctttaccatctgtctctttctctaacttttgcaattccaaaacatcattcacttttctcacctcctttcgagtgttaacagacattcatttatcatctaatggggataatattatcaatttattccaactggaatatctttcatttttgtttccgctaaaaatttatctgtgttgaccaatggtaaccaataaagtggattgcttttaacaattcccattaatgctaacactatacctgagctgcctgtataaacatcatcagataatctataagaaaattgccccggataaacataataatcatttttctcaattaaaaagatattaagcagatccattacttccataagaattccctcccgcatttttctattatcaaccatagaagggattaaaaggaagcttcctgcaccatcaaataaacctccactgattgtgcagcgtatctttgatagatttaaaatggctctaaattcttctttaaatagatcttgtccacttacatggtttaaaaaccaaattgacgcagcgactccaatagaccctccagagagatatggcaataatcggtttctatcatctaaagtctgtaatacaccggttacatcatctttttttgtcttttccaagtctttctttaaaaataactcagcttcctctaaatatcttttattattggttgctgaataaagcgctgaataaaacagagagacgccagataacccatcaattaaacctatacctaccgccatccagtcattaacttttaatgactcgtctttaaccttatttaggtcaatcaatttttctatctctttcgcaaactccaagtattctttactttccgtctcaaaatataaactgattaagaacaggcctattcctgaaagacctgatcgtaaagaaatgttggttgtttcatttacattacttctcagaacattcaattcatttaaaacagtttccttgtaccccttctcataaagcagagccagcattcctgtttttccagttaataaaccattatcatcgccactcgataggttatccaccaaaaaactttgaatccaattatctacattctcagacttcgagttacatctggtaagaatataggcagcgccactccccccagtgagaaagttgaattttcctccgttcatttcaaactgacgaatgtcaccgtttacgagcctttcatcatctattaaattgttttctagaccctttatcaacttattaatcatggaatataagttgatatcccttttcttgttataaaggttaatctctcggggaagatatttgtgataaccttttattttatcatcacattttttttgcaactctaaaatgaaatgataaaatgattctccataattcatctttatccagtataaatggttatcttgcagatacccatccatatcgtctgaagagagcactggcagggctaaatatcttattaatctctttaacccaaaccagtctctagaaccacctgccttcatttcttgagaaacaaacccgattgttgccatactaggtttttcttcagactctacgggcattgcagtctcaaaatctattatcttaacggttaagtcttcagttaccatcacatttgctggctgcaaatcacccatagcaactccgttattatgcatttgatctatcagagcaaagagttgtaacaatattttttttatattcttagcatgattacatatactatcgccatcttcatctctaaagaatggatactcttgtgcaatccattgtctcaaatctcttccttcaatgaattcctctactaaaaagtaatgttcccattcttggaagtactcaattagattgaccacgccatgtatgttcttaagcttttttaaagtatcatattcaattttttgcctttctaacgcatctctgggtcctccatctaaaccagcatttggtctggcttctttaagaataactttcaagttatctttctttcgagtcgcaagatataccccccctgcgttactgtagctcagtgcagtaatgatatcatacttcgctaaatggctttccccctgttgttctgagtcgtcagaatgattgatcgtattaagataatcatcaaagtcttttacaaaatcagggatctgataaaagggtgttctttgatccttaattaaattaccactttcatccctaatacagtgctcaccatgttcattaaaaataagcttaaatccgccatatctgtaaaatacattagtattattccacctcttatcactgagtatatagggaccttttttgaaatcctttgttatttcagataagtcttgcaacaattcaacaaagatttcttcattagccgggtacaccgttataaatttgccggaagaagctcgatttgcattttttgaattcatgttaataaaactatgcatatcctttaggtgtttaaattcaattttcttacccatacaaaagcgggcaaccctatccaatacactttgtgcgtcctctaacaatgaagttaaatgaattttccacccctgctctggtaacgatacacccttaacatgataatatttccatactgagttactatctgagataacagtatatgtatcagggatgtcattcacttcatatgtattcattgtcatctcttgtttcccgaaatactcggaattcgccttcagatattgatgatatagcatgttgccttccataaaagcccccccatttttatatactaaatattaaccctcaaggtcacaaagttctttatatgcaaagacaacaccttatcctgttataacttgatcagcataaaatcaatacacacgcgctaaaattcttttttatgatatatagctgcggcgatgaaaaatgaaatgatatataagataacgccgatcatgagatatataatcgggacatataaagaaggatttatgtgcaaaaatgacagcggtacttgttctgctgcatacccaacgacactttgtaatccaaaggtagcaaaaagtccccccattgcccctccaatcacgatagcatcggatttttccgggcctatcatgtagagaagaggataaacgattgcaccggcaaagagaacgatgaacgttccaaaagagacaatattaaatataccgtcaattggttcatcagaacccaggctgtatacaaggaaaataccataagatattacagctccgatcacaacaatcaaaagataaaagaaatagtgactttgaacaatatttgttctgctgaccggtaaagtcagaacatacctgtcatagcctgacttgctctcatactttataacctcaagtgcgggcataacgacaaacaaaataatcagcatagcaacaaaacgatgcattgaagcatccccaaaataaaaaatgactgctgataccaatatggccaaccccgtgtatgcaaagaaactccgataaaccaagtaatagttagtcagtaacagacctctcaatgttttcactcctcgttaaaaagacgctgattttttctatggaaatggtgttggccgttacgccataaggcaatttctgttgatccgatacaagcacactccaataagatccatgattcctttttgctagaacgatatcttcgtcaatctcagccaattgaccttcatcaacgtctataacggtatagctttcaagaaccttatctttctcttcatttaataaaatttcgccatctttcataataatgatatggctggctatcttctcgacatcagtcataatgtgcgatgaaagtaaaatacctccgttgcttttactcacaaagctttttaattcatttaacagatcatctcttgaagagggatcaagccctcccgttgcttcatccagaagtaataattttgcattatgcgacaaagcaacagctacagataacttcattgacatgccgcgcgagaatgtattcacttttttgtccataggtaaagagaaagaatgaaccaactggtaaaattgatcttggtcccaagcgtcgaacagtttcttaaatacatgattcagctgctttatcgtaaggtgcgcaggaagattcatcgcatcaaatacgaccccaatatcttctttaaactttatatgtttattcagattctctttaccaaagattttcactttacctctatcctgagaaattaatcctaatatcgttttaaatgttgttgacttgcctgcgccgttatcaccgataaaaccgacaattgatccggcaggcacattgaatgtaacatcctttaaaacagctttatgaccaaaagatttgctgatgtttctgatttctaaaaggtttgacatcattccactcctatcattgttgtcaggacttttttaagaattgaaccggattattgcaaaaatgttgtgattttcatatctggtctaggtattcataatggatcaggagtcgggaaatacaaaagggattttaaagtcttaagcataatatggaagtgtaatcgattgattaggtttatataatgggatattcatgatgaaaactgctggaggtgacttacatgctggaaaagaaaatgtgtattctataatctatatatgtagtctcatcagataacagatttattgtctaattgagtagcccgttcaagagtgaagtatgtccaagtaatcagacatgggaataaaacaccaaacaaatacttattcaaaaaccaatatttgatcgctaccattctttactaatggttacatttatgggtttaaactggaatatatttatattataaaataggcgttacttcttttcaatatatatatggggatttctttataaatataaaattcttcagtttatcaacaggcgaacacttcttattttcatactaaaaacccctctggtttatctaaaaccagaggggtcaaactttccgactatattttaagtttatcgtgaattatttattcctattccacagtcacactcttcgcaaggttgcgcggtttatcaacgtcacagccgcggtgcagtgcagcgtagtaagcgatcagctgcaatggcacaacagataccagcggagcaagcgcagggttgacttccggcaggatgaatctgtcgtctgcgtcttctaagcctttcagcgagatgatgcaagtgttggcgccgcgggctgcgacttccttcacgtttccgcggatgctcaggttgacgtgttcttgtgtcgcaagcgcaaagaccggtgttccttcttcaatcagagcgattgttccatgcttcagctcgccgccggcgaagccttccgcctggatgtaagaaatctctttcagcttcagggcgccttcgacacatacgaagtagtcaaggccgcgtccgatgaagaaagcgtttcttgaaacagtcaggtactcacgcgcgatcatttccatttcgtccttctgatcgcagagggcttccatggcgtttgccgcgatacctaattctttgactaaatcaaaaccgatatcaacgccgttgcgttctgctgcaacggacgcaaggatcgcgaggacggcaatctgagccgtatacgcttttgttgatgccacggcgatctcagggcctgcgtgcagaagcaatgtgtaatccgcttcacgggaaagcgttgatcccggaacgtttgtaatcgtcagcgctttgtgacccagcgctttgacttgaacaagcacggcgcggctgtccgctgtttctccgctttgagaaaggaagataaagagcggcttcttagacagaagcggcatgttgtaagagaattcactcgctacatgcacttcaaccggtacgtttgcccacatttcaatatattgtttcccgacaagaccggcgtgatagctcgttccgcaagccacgatataaatgcggtccgcttccgccacggcgtcagcgacatcgcccgccacggccagtctgccgttttcgtcctgatacgtttggatgattttgcgcataacaagcggctgctcatccgtttcttttaacatgtagtgagggtatgtgcctttttcgatatcactggcgtcaagctcagcgatataagacgcacgtgtcatgacttcaccgtcaagatttttaatcacggcttcgtcttttgtcacgatcaccatttctttgtccaaaagctcaacgtattcattcgttacttgaagcatagccatcgcgtcagatgccacgacgttaaacgtatctccaaggccgattaacagagggcttttgttttttgcaacgtaaatggtgtctgtgttttcaccgtcaaataatgcaattgcgtaagagccttttaacagagtcagtgttttgcggaacgcttcttctgtgctgagtcctcccgccacaaattgctcgatcatttgaacgactacttcagtgtccgtgtcgcttttcagttcaacgttttcaagatactcgcgcttcagctgaacatagttctcgatcacaccgttatgaacaagtgtaaagcggccgagtgcgctttgatgcgggtgagcgttcaggaagcttggttcgccgtgagtcgcccagcgtgtatggccgattcccgcttgagattcaaccgtgtgatccaccacttcacgaaggtcggcgatgcggcctttttctttgtacacatgcacgccctgctcattcgccacagcgataccggcagagtcatagccgcggtactcaagcttctctaatccttttaacaaaatctctttcgcatcaagctgaccgatgtaacctacaattccacacatattttcttcctcctaaaggtgtaaaaggagacgaagaaagtcaaattacaaggggactttcaatcgtcccctcccacatgtttttttggaagatcatgtgatttccctttgttcggagagtcgcccctccggtttgaagaaatccttacggctgtgatctaaatgaatcagccgggaggcatccgccgaaaattcgataacctccatcctcgtcaactaagccgtttttcgggcgcttagttcgggcgctgtaattataaaagatgcaaacaatcccgcctttcctgcaagtgaaaaacaaaggctgaacaagcttgattttacagcatgtgccaaggacggtcaattattttttgccgccccggcatcatgtttactatcattttatgctgatcgcacttgtcttgttcgctctctgcttataaacttcgctactccgctcccatttctgtccgcacgacatccacgatttttgtgacatattcgtcacaaagctcttttgttctcgcttccgccatcacgcgtacgagcggttcggtgcctgacgggcgcactaaaatccggccgtctccgttcatttctttttccacttcagaaatcacggccttcaccttagcgttttcttctaccttatatttatccgtcactttcacgttcactaagagctgcgggaattttttcatttcatccgcaagttctgaaagggttttgccggacgccttcagcgtattcacaagcatgatcgcggacaaaagaccgtcgccggtagtgttgtaatcaaggaaaataaggtgccctgactgctcgccgccgacattatagccgtcttttttcatcgcttctacgacatagcgatcgccgactgccgtttgaacgcttttgatttcttctttttcaagcgctttgtagaaaccgaggttgctcatcacggtcgatacgacggtatcatccttcagacggccttctgatttcaaatacttcgcgcatatgtacatgatctgatcgccgtcgacgatgtttcctttttcatcaacggcaatgaggcggtcgccgtctccgtcaaacgcaaggccgatatcggcttttttttctttgacgaaagcactcagcgcttccgggtgtgtagaaccgacgccatcattaatgtttaatccgttcggagacgtccccattgtagatacgtcagcatcgagatcggcaaaaaggtgcgtcgcaatggaagatgtcgcaccatgggcgcagtcaagcgctacatgaatgcctgtaaaatcttcgtccgccgtctgttttaaaaattgcagatacttttgaacgccttcaaaataatcgttcacaagcccgaggtccgcgcctgtcggtctcggcagcttatcttccggttcctccatgagacgttcaatctcggcctcctgctcatcagaaagcttaaagccgtcccctccgaaaaatttaattccgttatcctgtacggggttgtgagaagcggagatcatgacgcccgcctcagcatccatggctttcgttaaataggatacccccggcgtagaaataacgccgaggcgcatcacttcagctccgatcgataaaagtccggcgacaagggctccctccagcatatgtccggagatacgtgtatcacggccgatcagcactttcgggcgctgcttatctttggtcaggacataaccgccaaaacgccccactttaaaggccagctctggcgtaagctcgctgttggcaacacctcttacaccatctgttccaaaatacttgcccattttgtatcgctcctttttcattctgttgaagaagaatcagcgcttgatccgtcttcatcctggtcttgattttgatcctggttttgacttttattctgatcgctgtcagtgtcgtcttcccggttcttgctcttgtctttgtctgcgtctccgcttgtgccgttcttattgccggaatcagcggagccgccgtcatttttatttgaacttgtgtttttcttagaagtcagcttgatcttaaccgtgtcttttgacagggaccatgtgacgttttgcgggccgtttacttcaagctttacagagtgctctccgtcatccaagtccgagacattggcatacagttcaatgtccgactttttcagcgccttaatgttggcgggagagcctttggccgtaatatttatcgcctgcgattcagggtcgagaaactcaatctgctgtgagcctcccagtccgaccgtcttgattgcgacattgtcaaaatcctttttgtcttcactgtccactttaacatgaagcgtgattttttccggtgataccttagtgacgcccttaggaagcgggatatcggcattgatatcggtatctttatcaattttgcctaaatcaagagatacgccgtcaataaattccagtgaatccagcacatcctgcgggccgtaaaccgtcacctcactcggattcgagtcaatgctcgcaacgctcaccccgtccggaagacttcccttcctttcgattttgaaaggaagctttttgctcggactggctacgggaaccgtcactttaatgactgacggttcaacatcaacaggaagtgcgttgccgtctttgtcatagacggtcaccttcacttccttttcaatggtctcatttgcattttcaaggttcacggatgctttgacaagtgaaatgttatcaatcacatttttcgaacctgtaatctgcacgtttttcgggctgataatcggctgctgaggggtatatccctttttcattttgcttttattgtagtattcaacttccacgggaaaactctcagccgttttttcctgaatcgtaaccgtcgtgactgatgggttaatggagatcgtcagtccgtccgatacgttttttgccttcaattcgaccttatgagtcccggtcttcagcttattcatatcggcgtatatctcaaaattcttcgtctgtctcgcctttttcaccgcgcttgtcgagcctttaatcgtgacatttaccgtctggggcacgccggtgacgacatagttcgcttcatcgtagtatgcttttacaggaatatcagtaagcgtagcctcgtcagtcgttgatgtcggaaaaaaggattcccccggctttttcggagtcggcgcctggttgttgttaaccgcaacgtaaagcagcagcgccaagagcaatgcaatgatctttacagcccagcggttgtttaagaatttatccatttttcttgcccctccagtaccagcggttagaagaagtgtctctggcgttcttcttaaactcggcttcaagcatttctttcagtgcttcttccgtcaattctctgtgaaggtctccgtttctggccacactgatggcgcccgtctcttcagatacaataatggttaagctgtccgtcacttcactgatgccgacagccgctctgtgacgcgtccccagctcctttgaaataaacgggctttcagaaagcggcagataacaggcagccgcagcaatctcgttatttttcataatgaccgctccatcatgcagcggtgtattcgggatgaagatattaatcaaaagctccgagctgacctgcgcattaagcgggatgcccgtctcaatataatcgcccattcccgtatcgcgctcaatggcgatgagtgcgccgatgcggcgtttcgccatgtagctgatcgattttgtaatcgcttcaattgtcttatgctgcgcttcctccacaggggttccgctcctggaaaagaaccggccccgtccgagctgttcaagcgcccgtctcagctcaggctggaatataatgatgatcgctaaaaatccccatgttatcgcttggtccatcagccactgaagcgtgctgagtcccaaatatgaactggccatccggaccaatacgatgacgacgattccttttaaaagctgaaccgccttcgtcccgcgtatgaccatgattaatttatatatcacataccaaacaaggagaatatcaacggcattgccgaggtattgcaaaaatgggatgtcctcaaaagccatttcctcgtcctccaagaattcagtcatttcgtttttttcgttatgaattgtgctgcatgagcaatatgtacatcatatagcgtgctcattataccacattttgatttctcaagtgaaatgagccggcgcggcgttgcacaaaaaaagagtaaagcgattatacgctttactcatcttcattcgggtccaaagcgcttacgacgccctgtcccgccgatttcagttcgtaccagacccagtcaaacaattggttaatctcttcaatctgcccggtgacttgtccggctgaggccatgtatttttctccgttgacgacggtcacattgccgtcgacttttccttcaatgaacagcttgccgttttttactgtgacatcgccctttacggtctcgccttcagggacggtgaccgtgtgattctgcacgacaaggttcggctgtttggacacactgaaattgtggtcattatgccagctgttgaaaaaaccgccgcccattaaaatcacaaaaaccgctgcggctgcaatcatcggatgagttttgatccatcgttttacagaagcgcgttttttctcttttggaagattcgccataactttggcagtaaaatcagcaggggccgtgacatgcgatgtgcttcggacgagtgctacggatttctccatttcatgaaaatgccgtttgcaattcccgcatgactgcaaatgttgttttaatacgttttcatcttcaggaaggatatctccatcaagatgcttatgcataagctgcacaatctgttcaggacagctcatttcatcaccccacttaaagatccctcaattgttttctaagagcctctctgcctctgtgtatccttgtcttgacggtgccgacagggatattcagaatctccccgatttcaattaaagagagttcgtcaatatactttaatacaataaccgttctgtacttgtcaggcagctttaaaatctttttctgaattgtgtccgacagctccaatgacaatacggcgtcttcagggagaaccccgtccgcggcgatctgcgaatacatcgtcagcccttctgctcccgctacttctgcgtccagatagtaatcaggctttttcttgcggatacggtcaatggtcaggttggtcgcaattctgtaaagccacgttgaaaactttctgttgatatcgaaactgtcgatattgacatacgctctgataaaagcttcctgcgcaatatcttccgcttcgtgcacattgccgagcatgcggtagcaaagctggtaaatcttatctttataaaggtcaacgatttctgcaaacgcattttgatcgccttttttgacttgcttgattctttttttaatcaggttttccatgttttatcttacctctgcccttcaccggtctgtatctatacgttgattgttttaaaaggtttcatttttttattacatttattttaccaaatttcaggcagggtgtagatggaaaatacagaatatactgccttaacagcagcttaaaaatagtatatctgatgaacaatcaaaaatcgaaacaaaatgccgataaaaaaagacacctttatgcaaaaggtgtctgagactgggctagctggattcgaaccaacgcatgacggagtcaaagtccgttgccttaccgcttggctatagcccaaaaatggtggaggggggcagattcgaactgccgaaccctgagggagcggatttacagtccgccgcgtttagccacttcgctacccctccatcatttagagtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatgacccgtacgggattcgaacccgtgttaccgccgtgaaagggcggtgtcttaaccgcttgaccaacgggccgttgtgtccgcgtcgagctgacaaaagttattatatacaggttgtaccccatttgtaaagagaaaaattattttttttattttcaaacttttttacccgttttttaactgaaaaactcatccctcctctcttatttcatttatgatgaaagtatcaaaatattgaagggaatggacacagatgatcttagtcagctcttgtctcggcggtatcgaatgcagatataacggctctcacgccgcttcggaaaaaatccgcagactcgtagaagaaaagaaagctgttatggtctgccccgaacttttgggcggcttcaccactccccgcgaaccggcggaaatcatcggcggcacgggtgaagacgtgctgaacggaacggcaagaatcgtaacggcatcaggcgaagacgttacagctttatatatggacggcgcggaaaaaacgttagcatacgcaaaagaaataggcgccgcaacggtcatccttaaagaaaacagtccgtcctgcggcagcagctttatctatgacggcactttctcaggaaaaaaaatactcggagacggcatcacttccgctcttttaaaacgggcaggctgccgtgttctatcagaagatgaattggatcaattataaaaaaggagagtagatatcatggatgtagccctgtccttttataaaccggagcatgcagacgggctgaacgggtttgtgctgagtgaagaagataaaaagttcacagctctgccgatagatgtcctgccgcaggcgcttgtcatccgggatcgctacccgacagtcattttaaaagaagaccgccccgtcggtttttttattttacatacctcaaaagaaaccattgctccgtattcgaacaatgtgtctgccattttgctgagtgcgctgtcattacatgcgtcgcatcagggaaaaggttatgccaaacaagcgatgctgcagctccccgcttttgtcgcaaattactttccttggtgtgatgaaatcgtgcttgctgtaaaccatcgcaatcaacgtgcaaagaacctgtaccggtcttccggttttattgacaaagggcggcgcaggatcggcccgatcggtgaacagcacattctgcatcattttttgtgaaagcgcttgattattcatctcatccctgccgatttttcttgaaacatctattcagaagcccatatacttcaagtattaacgacttgggagggtacaatcatgacagaccggcttaacattcacagattgaccacagaaaccagaaatccgcagaccgcttcaatccatcaggcagacacgatggaaattctccgcatcattaacgaagaggatttcaaagtggctgaagccgttcagcaggtgctgcccgatattcaaattgccgttcaattcgcccatcagtccttacggcgaaacggcaggctgatttatgcgggagcgggcacaagcggcagactcggtgtactggatgcggttgaatgcccgcctacatacagcgtaagtcccgacaccgtcatcggtctgatggccggaggggcagacgcctttttgcaagcggctgaaggtatagaagacagcgaggaaaccggcgctctcgatctcaaaacgatcgggcttaccgcagaagacaccgtgatcgccatcgcggcaagcgggcgcacgccgtatgcggccggtgcgctgaaatatgcaaaaataatcggcgccaaaaccgtcgcgctcacatgcaataaggactcattgatcagcacctttgccgatcacagcatcgaagtcattgtgggtcccgaagtgattacagggtcaacacgaatgaaagccgcgacggcacataaaatgattctgaacatgatttccacggccgtgatgattaaaagcggcaaagtgtacgaaaatttaatggtggacgttcatgtcagcaacgaaaaattgaaagaacgcgcaatcggcattatccaaagcatcacgggcgttccgtacgacaaggcaaaagaaacgcttgaggccgcagacagccatgtcaaaacggcaatcgtcatgctgaagacgaattcggacgaaacacacgcgaaagcactgctcaaagaatcagaaggattcattgataaagccattgaacagcacgtttcaagagaaaaagaacgctgatcgttctttggagaaaaatattgtgcttttacgagcccgcgccgttttcatgttcggcgcaggcgcttttaggacgcgtttcaggcatagctccccgggaaaaatcgtacggaaaaaggaggatctccatgagcaaagaggcattttatcagtcactggccaaagatatcctggacaattgcggcggttcatcgaatatttcaggctttacccactgtatgacacgcctgaggattacacctttagatcgggacaaaacggatattgaggcgctgaaacggcttgacggggtaataggcgtcgtcgaagccgaaacactgcagatcattctcggcacgggtgtcgtcaatcatgtcaccgacgctttcgcaaaacttataccatccggaaaaaacattgatttaaaagaagccgcctcacggaaaaaagccgatctcaacagaaaaaacaccacacccatcaaattgtttctgagaaaaatatcaagcatcttcattccccttattcccgcactcattgcatcaggtttaatcaccggtattacgaaagccgtcattcaggccggctggctcccgaaagaatcccaaatcgcacttattttaacggttatcggttcaggcttgttcgcttacctcggcgtccttgtcggcatcaatgcggcgaaggaattcggcgggacacccgcgatgggcggccttgcgggcatattgatccttaaccctgagatcgccaatatcagtttgttcggagagaatctgctccctggcaggggaggattaatcggcgttcttttcgctgcggtttttatcgcttataccgaacggtttatcagaaagcacgtccatcaatccatcgacattatcgtcacgcctacattgtctttacttatcaccgggctggtgacatatgtcgtttttatccctgcaggcggttttatttctgatctgattacatcaggtttattgtcgctgctgaatatcgggggagtgctctcagggtttgtactgggagccgccttcctgcctcttgtcgtcaccggcctgcatcagggcttgactcccgtacatttggaattaatccgctcaatcggagatgacccgcttcttccgattctcgcgatgggaggcgcgggtcaagtaggcgcggccttcgccatctttatgaaaacaaaaaaatcctcattaaaaagagcgatcggcggcggacttccatccggtctgctcggaatcggggagccgcttatcttcggcgtcacgctcccgctcggccggccgtttttgacggcgtgtttaggggcgggaatcggcggcgcctttcaagcccattttcaagtggcgactttttcaatcggtgtctccggccttccgctctcgtttctcgtacagccggctcaaatcgttttgtatatcatcggtctcttcatctcttacgcggcaggctttgtcttcacttatgcgttcggatttaaggatgacatggctgctgaatttgaataaaccgggagggatcagaatatgaaaacactgacagccgccatactcacaatggtcatcagcctctcttttctgccgcagcacaaagccgaagcccaatccaaattatacgacgcagcaaagctcagaaaggttgatcaaatgattgaaaaagacatcgcagcaggattccccggagccgtcctcatcgtcgtaaaggacggacgggtgatcaaaaagaaagcatacggctacagcaaaaaatatgacgggaacacccttttatcccgtccgaaaaaaatgaaaacatcaaccatgtttgatttagcttccaatacaaaaatgtacgcggccaattttgcactacagcgactcgtcagccagggaaagcttgatgtgtatcaaaaagtctcggcttaccttcctgatttcaaagacagaaaaagcgatccgattcaagaaaaagaccgtatacgcgtcatcgatgtgctccagcatcaatccggtctgccggcaagcttttatttctatcagccggacaccgcaggccctttatattcacaagaacgggataaaacaatccgttttctcacccagatcccgcttgaatacaagccgggaacaaaacacgtatacagtgatatcggttacatgattctcggatgcatcattgaaaacataaccggaaaaacccttgatacctatgcggaacaagaactgtacaaaccgctgaaactgacgcacacactgttcaatccgctgcaaaaaggttttaaagaaaaagcattcgcagctactgaacgtttaggcaacacacgtgacggagtcatccatttccctcacatcaggacatatacgctgcagggggaagttcacgatgaaaaagcattttactcaatgggaggggtgtccggtcacgccgggctgttttccagagctgatgatatggccgtccttcttcaagtcatgctgaacagaggcagttataaacacgtttctctcttcaataaaagaacggccgatttgttcacaacggcggcatcctctgatccgactttcgctctcggctggcggaaaaacggcagcccggatatggagtggatgttcggaccttatgcaagcaggcaggcatacggccatacgggatggaccggcaccatcacgattattgatcccgcttataagctggggatcgcacttttgaccaataaaaagcattcccccgtcgtcagccccggtgaaaacccgaatgtttttgaaggggatcttttcccgaccggaagctacggcagcgtcataaaagcgatttatgaagccattgaatgacaacccatgtcttttgtccaaactatgacggcaggagggcaccatcatgaaacttttcatctcagctgtattactgttgttcattgtattcggcacgcatcatgcatcaacaaaaccggacattccgtcacaggcggaacaagcggtatcccgtatgacattagatgaaaaattagggcagatgctcatgcctgattttcgaaattggcaaaaaaaggggcagtcatcacctgaggctcttacccaaatgaatgacgaagtcgcagggcttattcaaaagtaccggttcggcggcgttatcttatttgcagaaaatgtaaaaaacactgagcaaacggtacgcctgacagatgcctttcaaaaggcgagccctgacattccgctattattaagcattgatcaggagggcggcatcgtaactagacttggtgagggcactcatttcccaggcaatatggcactcggggctgctagaaaaacagcctacgcgtcccagaccggcgccattatcgggaaagaactgaaagcactgggcattaatacgaatttcgcgcccgttctcgatatcaataataatcccgcaaaccctgtcatcggcgtcaggtcgttcagttcagaccgagatctgacagcttcactcggccttgcctcaatgaaggctcagcaaaagcagaatgtcgctgccgccgtcaaacatttcccgggacacggcgacacggatgtcgacagccactacggtcttccgcttgtcacccacaatcaagaaaggctgcgtcagattgaactttatccgttccggcaggccattcaggccggagctgatatgatcatgacagcccatgtgcaatttcccgcttttgacgatacaacctataaaagcaagctggacggttcagacatcctcgtacccgccacactctcgaaaaaagtgatgactcatcttctccgtgaggaaatgggatttaacggcgtcatcattacggatgcattaaatatgaaagccattgccgatcatttcggtcaggaagaggcggtcgtcatggcagtaaaagcaggagtcgatattgccctgatgccggcccaagtgacatcgctgcaaacggaaaaccgctttgcccgggttcattccgctttaaaaaaggcggtacaaaaaggggatattccgctgcagcaaattaacaaatcagcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaagatccgtcaccgtcttacaaaacaaaaaccgcacgctcccattcaaaccgaaaaagaacagccgcgttctcattgccgctccttatgaagatcaaacagcggcaatggaacaaaccattcggcagctcatcaagaagaaaaaaatccggccggtaaccatcagtaaaatgaacttcgccgagcgcacatttcatgatgaacacaaaaagctggtatccgacgcggattacgtgattacaggctcctatgtcgtaaaaaatgaccctgtcgtaaacgacggcgtgattgacgattccgtcacagatcccggcaagtggacgaccgcatttccgcgggccgtcatgaaagccgcacaatcgaaccaaaaaccctttgtgctgatgagcctgcgtaatccttacgacgccgcgaattttgaagaagctgaagcccttatcgcagtctacggctttaaaggatatacagacggacaattcctccagccaaacattccggcaggcattgaagcgatattcggacagacaacaccgcaaggcaggctgcccgctgacattccttccgtcacgcatccgggaacgacactgtatccttatggtttcggtatcaatctgaagaccggaaaaccgctttaaacaggagggctgattatgaaaacacatacggctgcacttctcgccggacttgtcgtcatcagtgctatgacagcagtctcggcggcttctgacagaaaccttcataccgccaagaaaccaagcatccaaacaggcatcgaccgcctgctgaaagattataaacaggaactgaagggaaaaagggtcgggctgatcaccaacccgaccggtgtgaacgcatcattgaaaagcagcgttgacgtgctgtatgaggcgccagacatccgcctgacggcattattcggaccggagcacggtgtccgcggcgatgctcaggccggaggcaaagtcacatcctatatagacgaaaaaacagggcttcccgtctacagcctatacggggagacgaggaaaccgacacctgacatgctgaaagatacagatgtgctgattttcgatattcaggatgtcggaacccggtactacacctacatttatacaatggcctatgccatggaagcggccaaagaaaagggcattcctttttatgtcttggaccggccgaatccgcaaggcggacgaaatccggacggcccggttcttgaaccggattacgcttcatttgtcggactgtatccgatcccgctgaagcacggcatgacgatcggtgagcttgctcttttattcaataaagagtttcatattggcgccgacctcaccgtcgtaaaaatgaagcgctggaagcggacgatgacgattgaagataccggtctgccgttcgtcctcccttcgcctaatatcccgaccccggacagcatattcgcatattcggcaacaggactaatcgaaggcacaaacgtgtccgaaggaaggggcacgacaaagccgtttgaacttatcggcgcgcattatatgaaaagcaccgagctcgaagaacgcctgaacagtctcaagcttccgggcgtcaccttcagagccgcttcattcatccccagcttctccaagcaccagggcaagctgtgccacggcgtacaagtctacgtaacaaacagaaacacatttgaagcggcaaaaacagggctctccattctgaaaaccatgcatgacttatatccgaatgacttttcattcttgccgacaggctcttttgacaagctgatcggtaacggctgggtacgcaaaaaaatagaaaaaggcgcttccattaaagacatcaccggcacatatcaacgccggctggaccaattcaaaactctaagaaaacaatacctcatatactgacaacatccgtgttacacgtgtaacattttgtcgcatttcacatttccgctttttataggaaaacattcatttatttggtacaatttaattgataacagttatcatttaaatgaatgtttcttaaaaggtggtttctcatgaaaaacacattattctttcagcccattgatatcatctccgtgaaaaaaacagccgaccttctgtcagagcatcagctcactgattcccccgtattgatctttcatgtgaaaggcgagggacaaattgatatcggaacagacagctttccgctgcagaaggaaacgctctacatctgtccttgtgatgagacattcaatattgcccctatatcgtcaggcggcatccatttgtatatcgtcagactccgtgttttctcctattcctcagatgatgaagcgatgcttccggataacggggaagacatcttccacggacttcagcaaatgaatttacaaacggttgatcatttgacaagccggcttcaatcactttctgaaaacgtgcgatcggcggatggattgcagaaaatgaaatataccgccgactttcagcagctgatgtacgacctttatgccgcaaaagtatgccatcaaaataatacgaaagcggcgatcgaacagacaaaacaattcatacatgctcagtccgacacaaaaatcacgctcacccagctcgctcatatggcgggaatcagtcccaagcattacagtgaaacctttaaaaaactatacgggcagagcgtaactgaatatatcacagacatccgcataaccaatgcgaaaaaactgatggccaaggcaagctgcaaactgcgggaaatcgctcatcaaatcggctaccaggacgaattttatttcagccgcatctttaaaaaacataccggcagctcacctacaagctacatgaaaaaaaggcgcacaaaaatggccgcgtacggaaaagaaacgatggggcatctgattcctctgcatcacgtgccttacgctgcggcgctgcacccgaaatggacggcctattattacaaacaattctcttccgatattccggttcacctgagcgcttaccgctataatgcaaattgggaagacaacctgcatacgctgtctcaagctgccccggacatcattttcagtctcgattctgtcagtgaagaagaaaaacagcgcctgaatgacatcactgaagttttttatcttccggctcaagagaattggagagaccagtttcttcgcacagccgcatatctgaatgaagagcaggaagcgcggcactggcttaaaacttatcaaagtctcacccattcagcgaaagatgctcttaaacacgtgcggcaccagcggttcttatttgtccgtgtatataaagaaaatatgtacatcgcccataacaacagtattgaggaagtcttcttcggtgatttagactttgcctccgcaaaaccggaatcttttgctcctgacgaaaagatttccttggaaatgctggcggattgccaggctgactgcatcatgcttttcacttgtaaagaaccggaaacgcttcgctattttcagcggattcagcagtccgggatatggcagaaccttagtgccgtcagcaataaacgcgtgtttcccatttcatctgacccgtggattgaatattctccaagcggacatcagcggatgatcgagcaaagcatttccattttatccgaagatcgtccatggtaatgccgaaaattatccatggtcttatccctattcattctctataattccaattgataatagttatcaattgaacaggaggaacaatagatgaagaaattggcattcgctttcatgattttgcttttggctttcacggccgcggcttgcggaagctcagaaacatctgatacagcaagtaaaggaaaggacgcttcttcagataaaaagaaaatcgaatatctcggaaaaacatatgaagtcaaagcgccgactgacaaaatcgccattacaggcagcgtagaatcaatggaagacgccaaattgcttgacgttcatccggcaggagcaatttctttctccggcaaattcccggaactgtttaaagatattacagataaatccgtatcaacgggggaaaaaatgcagccgaatatggaaaaaattcttgagctgcagccggacgtcattctggcatcaaccaaattcccggaaaaaacgttgaaaaaattgagcggcaccgctgaaacgatccctgtctctcatatctcatcaaactggaaagaaaacatgatactgctcgcccagcttacagataaagagaaaaaagcgaaaaaaatcatcgcagattacgaacaggacctgaaaaagacaaaaacaaagatcaacagcaaagcgaaacagtcaaacgcgctggtcatcagaatcagacaaggcaatatttatatttatcctgaacaagtttatttcaactccacgctttacggtgatttaggcctgaaggcgccggacgaagtcaaagcggcgaaagcgcaggaactgatttctcttgaaaaattaagcgaaatgaaccctgaccatatcttcgtacaattttctgatgacgaaaacgcagataagcctgacgctttgaaagacttagagaaaaatccgatctggaagagcctgaaggcagtcaaaaaagaccatgtatacgtcaatacgattgatccattagcccaaggcggaaccgcgtggagtaaaatcagcttcttacaggttgcggctgacaaattgactcaagactaataaagagtaggtttttcacatgtatgcaaaacggcggacacacattattatcattgcttcaccgattgccattgttctgtcactgctcctttccgttttatacggcgcaaagcagcttgacatccataccgtgttctccgcattgctgcactttaatccggagaataccgaccatcagatcatatggcattcaagaatcccgagggctgccggcgctatgtttatcggcgccgcccttgctgtttccggagcgctcatgcagggaatcacacggaactatctggcctcgccttcgatcatgggtgtgtcggacggctccgcttttatcatcaccctttgtatggtattgctccctcaatcgacatccattgaaatgatcatatactcgtttatcggttccgcattcggcgccgctcttgttttcgggctggcctccattcttcccggcggttttaccccggtgcagcttgccattatcggaacggtgaccagtatgcttctcagcagtctgtcggctgcgctttcgatttattttcaaatttcgcaggatctcagtttttggtacagtgcgagactgcatcaaatgaaccctgattttttgaaactggccgtcccgttttttgcgatcggaatcattacggccatgattctcagcaaaaaggtcactgccgtatcattaggagacgacatttcaaaaagtctgggacagcagaaaagaaccatcaaactcatggcgatggcggctgttgtcatattgaccggaagctcggtggcgctcgccggaaaaattgcctttgtcggtttagtcgttccgcacatcacacgttttctcgtcggatcggactacagcaggctgatcccatgcgcgtgcattatcggcggcgtctttctgaccctttgcgaccttgcgagccgattcatcaattatccgtttgaaacgcctattgaagttgtcacttctatcatcggtgttcctttctttctttatttgattaaaagaaaaggaggggatcagcgtggtgcgtaaaatggccggaatttatatcattctgattgctctcatattgctcgtaagttatttcagcatgacaagcggttctttttccgcaaagccgggtgaactgctcagtacgcttttccgcatccatccgaatccgcaatatgacattttgctgtttcagctgaggctgccgcgcatagtcatggctgctgccatcggactcggattggggatagccggagccgttattcaggccattaccaaaaacggtcttgccgatcccggtattttgggcattaatgcaggagccggagcgggaatcgtcacgtttatgcttctgtttcagggacaatctgaagcgacggcacttgcctctgcgatgggtatgcctgtcttcggcctcatcggaggactgatggcggccgtgctgatctatattttcgcctggcaccgggggcatctggaatcgggcagaattattctcgtcgggatcgccatgaattccggattcagcgcgctgtctttatttctatcattaaaaatggacccgcaggattatgagatggcgatggtttggaaaaacggcagcatctggtcggcaaactggatgaccattacggcaatccttccgtggctgatcttgttcattcctcttcttatggcgaaaacgtcattgcttgataccattcgtttcgatgaggacacggtgaaaagcctcggtgtttcaaccaataaagaaaaaaccattttactcattgcctgcatcgctttgatcagcgcatgtgtaaccgcagcgggcagcatggcatttgtcggactgatcgcgccccatatttcccgcaggctcgccgggattgagcacagatactcattaccggtcagcggactggtcggtatgctcctcgtcatatccgccgactttgcgggcaaattgttctttcagccttcagaagtgccggcgggaattatccttgcgattctcggcgttccttatttcttttttcttctgtttaagcaaaaaaaggggatggacgcatgagaggcacccttacagaacacccgataaacggaagggaatgcactgtgtatcttcctccttcctattcggttcaaacaggggctttaccctgtgtgtacgtacttgacgggggttctttgtttttagaacagatagataagcttgaatcccaatttacgaacggaacacttcccgaattgattttcatcggcatcaaaccggctgacagactcgatgagtacacgccatggcccgcgccttccctgagccctgcgtttcatgatttcggcggcaaagggaggctctttctcgaggagctgacaaatgtcattattcccactgttgaagatacgcatcacatttctgtgcatccggaaacgagaggactgatcggtgcgtcattaggcggactgttttcgatatacgcgatgctgcaaaagcctgaaatattcggcagaatcggctgtatttccggttccttctggtatgaaaaatcagcagattatgtccgctccgcacctttgcggccggcacggcagcgtatctttatgtctgtcggcagccgtgaagcagagcaaaaatgtaacatccaaaacaccatgatcggacaaaataaagaagtgcataaaagcctgaggcaaaaaggcttttctcaatctcagctctctttcactgtcgaagagggcgccgtgcaccatcaagaagcgttcaaacgacaattcaattcagcactaagctggctgtacggaaaaaaccgctcacgtgactgagcggtttttttcatacttgatcacgaccggcttaagctcaaagcgtctcagcaaatagccgaacaaagcggcaaggatttgctgaaagagcatcccgatgacgaccggaacccccacttgagacggaaaaaaagacacggcgagaacggctccggcgctgatattgcgcatgccccctgtataaatcagagacacgatttcatcctggctccgcttcatcagtcttccgatcagccaagccacggcataaccggtcatggcaataaaaaataccgtgcctgcgatgcccgcaaatttgatatccacgtgcgtgacatacggcgcgatttccgaactgttaatggcaatgacaatcatcagacagatttttgaaaaaggagacagtgaccggcttatcgcctgagtccttaccggcggggaaaactggttgaccatcatccctgcgatggacggaatcaccaccatctccgccagccctttcatcatgccccacacatccatctgaacattcgccccggccaggacagacaggcttaatggtacgataaaaggagaaagcacggtatcaaccaggataatagacagcgtcaatccgacatttcccttatacatcgcagcccaaatcaaactcgtaattccggtcggaatcaccacacccataatcagccccgtcacagttaaagggtcaccgctgaaaatcagatggccgcttccccatgcaaaaacaggcatgaaaatatgcagaacaaacaatgccatgatcatcgggagcggcttctcgatactgcgcttcagcgattgaaaattggcactcagactgcccgtaaatgtaataaatgcaaatatccacggcacagcgccggccatccagctgatatgctgagataacagcacacccgccgccacactagacggagtcaaaagcggcatgattctccccaacacttggttcaatttttgaagccacatcatatgcaagtctcctatatacggttttcaagtctcattcattataacaatgcacaccggcaaatttaaccgaaaaaaagcccggatatattcatccggacttcacaaattctatgccatttgtttcattaaatctcggcttttctgatttaatccctttaattcagcctcaattccgtattctttacatttggcgacaatcttctcaagagcagccgctccagaatcatcccacacgtgggcatcggtcaaatcgatgataatccgtttcacgtcttcatcataaacgatggcattcatcagttcagacacggaagcaaaaaagatctgtcccgttaccttataagttctgacatctttctgttcggaatgtgacacaatcttcagcttagaaattttcgccgtaaaaaagatcgcgcttagcagcacacccgcgaaaacacccttcgataaatcatttgtcagaacgaccgtcacgacggtaatcaccataacgatcgaatcagtaaggggcgctttccgcaaacctttaatcgatgaccagtcgaacgtgccgatggacaccataaccatcacggccacaagcgcagccatcggaattttcacgacgataccgcttaatacggcaattaaaaacattaaaaacgctccggccgtaaaagccgacaaccggccgcgaccgccggctttcgtattaatgacagactggccgatcatggcgcatccggccatgcctccgaaaaacccgttcacaatattggcgatgccttgtccgcggctttctttgttcttatcactatccgtatccgtcatttcgtcaatgatctgggccgtcagcaacgactcaagcaatccgacgaatgcaagcgccagtgaatacgggaaaataattcgcaatgtctcaaacgtccacggaacatccggtatcaagaaatgcggaagtgaacttgtaatcccgcccatatcaccgaccgtgcggacatccgcatggaagaccaccgcaatgatcgtcatgacaataatcgccaccagcggagacggtacagccgtcgtaaccttcggcaaaagatatatgatagccagtgatccggcaagcatggcgtacatgacccatgaagctcctttgaactgcggcagctgcgcagaaaaaatcaagatcgccaaagcattcacaaatccgatcatgaccgaacgcggaataaatttcatcaatttcgctatcttactgacaccaagaataaattgaataatacctgtcaaaatggttgccgcaaacaaatactgcagcccgtaatcagccaccaatgtcaccatgacaaccgccattgaacctgtagcggctgaaatcattcccggtctgccgccgaagatagaaataataatcgcgatacaaaatgatgcataaaggccgaccatcggatcgacacctgcaataattgaaaatccgatcgcctcagggatcagagcgagagcaaccagaataccggccagaatgtctttacgtacattcccgaaccattgctgctgtaacgtataatctttcaaatgataacgactccttttcactataaaaatccgcaccttatcagttggaaacattgatttttatctggggaatatgaggcaagcttacggggaaaaggggacacgctcagagtataatgtcttgaggaaaggaatggttaacaaagagtatcatattaaactttaaagaaatgtgcaagaccgtataaaaaagaaaagaaaacggctctcactggagccgtttccgcttttataaaagttccggatcagacacaagaatcgtttttattgcgctgatatcctttctttcttttgtcaccgggtcgatgcccatgagatgatcaatggcttcttcataattcttcagttccgtcttttccgtaataaaatcatagagctgcggaaggtcggacgcgcatgctaacgcagcctccatgatctgacgggcttcacctgtgcccacaatcgttacgccgtttgacagcagctggtacggcctgactgtcatctcatacgtatcatcaaagcccatcggcacgattctgcctcccttttcaataaaaggataagcccaatcaagctgattgccgatcgcgtcaaaaattacatcaaattttcttccttgattaatccgtttcacttcatccacggttaatgcttcagggtggtagacataatccgatatccggctcgccgcctcgcttcggaaactgcctatttcagtcgcaaccgtcaatcgcgccagttttttcaccatcatttgcacaagcagtccgatcggtccggaccccaaaaccaagaccgagtcctccggctgaatcgaagctttatccacaacattcagcacacaggagagaggctcaaccaatgtggcccgctcccattccattgaatccggaattctgtacatgaacctgtcttctccgacgtaatattccgcaaacgttccgtgtgccccgattccgagctgccaatcctcgaaggtttcgcaataacacgtcagccctctccggcaataatgacatttcccgcaaaactgcgtaggatcaatcacgacgcggtctccgacttttacatttgtcacgtccggtccgatttccacgaccgctcccaccgattcatgccccataatcatatgatgggttgcattcatttttcctttcagcacatttaaatccgttccgcagataccggtgccgaaaattttcactttcacatcattggatttccgaatttgaggctcgtccacctcttgatattcaagcttatcattaggagtccagaccaacgccttcatatttctcttcctttctgccccagcggatttggtctaacaatgtttgatgaagctccttcgttgatgccgcaatacatgattgctggttctgataacttaaatctgtcagaagcgtttcgtccaaagaccggccgtatgcatccgtaatgaccactcccgctttcttcgccaaaaagacgcttgcggcaatatcataaggaaacaaatgcagcacctgtccgttcccgacctgctgaaaatctgaaagcagcttcggatcatctttcagcagacgattgccgatatccacataagcatccatctgccccgtgataattcgtgaaatcgaataagaagcgctgttgaaaacaaaaaccccgccattattggctgaccggtcaatcagatgaccgtatgcatccgtcatcagctgtgccggatgcccgttaaactcaaggctccaaaacatatttttaatatcccgcacttcgctcaagttcggcaattctccctgatacccctcaaactgaatggcgtcgctgtaaatatcaccgtacatgtaagcgcccgatttcaattcaagcaaaaaagcaaattcgatatccttaatctttgcgtttggcttatatgaagcaagcgcaatcgaaatacacgacatttcaagccccgcggcggccggacgcgttccgtctatcggatctacaattaaaatatattgcggatcttctccaatcagcttcaggccgccatcctccgtgtaaaaagcaaccggatggcccttatcttgaatataatccagcaccgcctcctcagcagcggcgtctatgttaaattgggcgtcgcctcccggagaatagccgtttacgagccggtttttcagcgtgcctttttgacttttcaccttatgataaacaaattgtccaagcccgatgatatagtctctcacttgatttcctccaatagcttgcgaagtctgtagcagagcacttcggcttcactaagtgtaatggttaaaggcggacggattttaaatacatttccgaacccgtaacgggatgtccggagaatcagcccgtaatccattgcccgttttgcaatataattggtcagctccacatccggttcattgttctcttttacaatctccacaccgatcataagaccgacgcctcttacctcagaaataaaagcgaaatcctctttcatcgtttctaagcgatccataatataatgaccgaccgtcgttacattttccaaaaatcccggacgctgcatgatatctatggttttacacgcggcagcagcggccatcacatttgagccgtacgtgaaggagtgcgtataccccggaagcccggtatacttgtcctccgtcagagtggcggcgacttggaagcctgtgcccccgagcccttttgctaccgtcatcatattaggtttcacatcgaagtgttccgcggcaaacattttgcccgtccgtccgaacccggtctgaatttcatcaaaaatcagggcgatatcgtgttcatcacaaagctgtctcagctgtttaaaatactctttaggcggaacgacgtttccaccgtttccggatatcggttcaataatcatggcggcaatttttccattgctcgcatactcaataaaatcattaattctttctacgcacagcataccgcatgaatcaggtttctgattataaaaacagcggctgcaatacggatcggggacttgaaggccaaaagaaatttgcggcgggaaaggttcttttctgaatgagttgccggacaaagcggaagtcatatacgtttgtccgaggtggcttcgaaataaggagatgacatcggtttttccggagtaatactgagccattttaatagctccttcatttgcaccggaaccgctgctgactttagggtgtacttttgtgagattatcgggggcgatttctactagtttttctgccagtttatttacggcgtctgtttgaaaagatgatgtcacatggatcagcttatcggcttgttctttaaccgtatcaatgacttctttgttaccgtatcctaaattcaagttaaatgtggcagaagcgcaatcaatgtactcattcccctcttgatcgtacaggtaaatcccttctccgcgctccattactacatcgtcaacactgtaatacaagctgtctggattcgtgatttccttcgttcccacaaataccacccctatgaaattattagaatttcgctttttatcgtattaattattgaaaataatgtcaacgatctttcttgtaaaaaatgttaacaatttgttaacgttaccataagggatgtacgagaaaaagttatgtgatatagtaacaatacttggattttttgtaaaaacgtcatgtcatacgagtagagagaaatattattttacgaataaggagataaaatgatgaaatctcgtctgctgtggataagctgtttttcttatggatcgattgcttttacacttgttattctgggagccgtactgcctgagttactcacacattattcacaaagctacagtaatggcggtgtattggtattctctcagttcatgggctttctcatcggtgttattggcatgccatacatggtgaaaaagcttgggcgcaaaaacgtcgttatctttggcctggcactcatcagctgcgaaatgttcatcaccttcctgccgccctggccgctgctctttcttctcgtcagcatcgcggggcttggcgccggattggtggaatcctgtgtaggcacgattatcctcaccgctattaaagaaagacaggctgtggccatgagcaagatggaagtggcctacggattaggtgcgcttttcatgcctctgctctcaggctttcttatcaacaaccacatgtggacaattgcttttttagtattagggttatccagttttgcacttttaatcgcatggaagcagatgagtttcggcagtattgatcagcttctcatccgaaaagaggtctcttccgatgacactaaaaaagaaagcaccggttatcggtcacacggattgctgtttattgccttggcgggggcttacttcttcttttacggaggcagtgaagtttcaattgtacattttatcccctccattttctctgagaaatgggatatccccaactctttggcaacgataacagttacagtgtattggacggggatgatcatcggaaggttattaacaggcccggtatcagaaaagctgacatatcaccgttatcttcgtctcataagcattggcggtctggcagcacttaccgtattggcactaagtaaaaacgtatggttcggttttgccctttgcttctttttagggctgttcatggcaggcatgtttgcaatagccctaatcatcacgaatcatttttatcccggaaagacagaaacgactaccagtattctgctcgcttcaaacggattaggaggttcactccttccgatcgccgtcggctggagcttagatgaatatcccgcacaaactgcgttctggctgtttactgcactgatggtccttatgctgctgattgtgttcagtttaagaatactcgagacaataaaatcaaacaatcttcaaaatcacaacagcaaagcaaaatcaatgtaaacaaaaaagctaatgcctttgaaaggcattagctttatatatctatgtgatctttcaaataaaaaagtgatctttcaaataaaaaaaccagttcatcatgaactggtttaagacagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataaca

SEQ ID NO: 129 - DNA, 47746 bp, Bacillus velezensis FL50S
cccaaaatattttgggctttttgttatgagaaatgacaaaaattccagttcgtttggttaatattcactaaatttttaaatattctataaattccccggcgatttctttataatattcacaaagaatgtaacctttcttcacatttaattaaacgtttgttgaagaaaaaaatgagaaatcggtcatttctgcaaaaggaatcgggccgttcactgtcgaataacttttatcacttaacatttcatgaggtgaagggggtgacggccgcctgcatcgtttcggtatgaccatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttgcggaaatgctggacagcattcaggtggaagcgacgttcccggacggggttaagcttgtcaccgttcatcagccgatcaaagcggaggtgaagtcatgaagccgggagcgattcaagtcgcaaaggggaccatcaccattaacgaaggccggaagacgctggaggtgtcagtcaccaataacggaacgcggtcagtgcaggtcggatcgcattttcattttgccgaagccaacggcgccctttccttcaatcgggacaaagccatcggcatgcgccttgatatcccgtcaggcacatctgtccgttttgaaccgggagaagagaaaaccgtcacgctcgtggaaatcggagggcgaaaaacggtcagaggtctcaacggcatggccgatacgtacatggatgagcggggaaaagagaagacgctgtcaaatcttaaaaaagccggatggatggaggaggcgatccgatgaaaatgtcgcgtgagcaatacgcagaactgttcggaccgacaacgggagacaaagtcagactcggagatacggatttatggattgaagtcgaaaaagatttcacgaattacggggaagaaatgattttcggcggagggaaaacaatccgggacggcatggggcagaacgggcgtatcaccgggaaagacggagcgcttgatctggtcattacaaacgccgtcatcctggattataccggaatcgtcaaggcggatatcggggtgaaggacggccggattgtcggcgtcgggaaaagcggcaaccctgatatgatggatggggtggacccgcacatgattatcggtgccggaacagaagtcatttccggcgaagggaaaatcgtaacggccggcggggtggatacgcatatccactttatctgcccgcagcagatggaagtcgcgctttcttcaggcgtgactacgcttctcggcggcggaacaggtcctgcgacgggaagtaaagcgacgacttgtacatccggtgcatggtacatgtcgagaatgctggaagcggccgaggagtttccgatcaatgtcggtttcttaggaaaaggaaatgcatccgataaagcgccgctgatcgagcaggtggaagcaggcgcgatcggcctgaagctgcatgaagattggggatcaacgccaagcgccattaaagcttgcatggaagcagcggatgaggcggacattcaggtggcgatccacacagacacgataaatgaagcgggctttttagaaaatacgcttgatgcgatcggcgaccgggttatccatacatatcacatagagggagccggcggaggccatgcaccggatattatgaaactcgcatcttacgccaatatcctgccgtcctctacgacgccgacgattccatataccgtcaacacgatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggtggccgataaaatgaaaaaacagcgcggcgctctatcgggagaaaacggcaatgacaatgtgcgcgccaaacgctatatcgccaaatacacgatcaacccggctgtcactcacggtctgagccatgaagtcggttctgttgaaaaaggaaagctcgccgacctcgtactatgggacccggttttcttcggcgtcaaacctgaacttgtgctcaaaggcggcatgattgcccgcgcccagatgggagatccgaatgcttccattccgacgcctgagcccgtgtttatgcggcagatgtacgcatcatacggtaaagcaaaccgcaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacatgtcgatccgaaaacctatcaggtgttcgccgacggagaagagctggcatgccagcccgtcagctatgttccgctaggacagcgttatttcttattttaatccctctccggccggtttcccgccggcctgtttaccctctattgccaacttgatttcatcctgccgcccgttttagtgtatattagtagttgacaaacaaatgaaatgtaactattttggttacaatggtggtgaaaaacatgattaacagccgtcttgctgtggccattcacattttatcgctgatctcaacggatgaacgggcgtcatcggacatgattgcgggcagcgtaaacaccaatcccgtcgtagtgcggagaacgatcagccagctgaaaaaagcgggtattctgacatcccgggcgggtgttccgggagccagcctgaaaaaagatccgtcggagatcaccctcttagaggtttacagggcggtgcagaataaggaagagctttttgcggttcacgacaatccgaatcccgactgtccggtcggcaaaaatattcagcgcgcgctcgatgagacgttcggaagcgtacagcgggcaatggagaatgaacttgcgagcaagtccctttatgatgtaatgaatcatctcttttgttaaaaagagatgggttcatgccgctagacgtgtaacgaaaatggttacaatggataatgaggaaatcacggttttggctccatattcagacaagcctggatgcgggattgcgatctgtttaatgaagaaaacctctgaaactaaaggaggtggtaaccgggatatttttattttgcttaaggcttatgtgaaggtgtctgttggaagcgggttaccaaaaaaagacggaactcttattttaatacgcgctaaaaaaactgatggagaatatcctgcctccggtaatgccaaaaccgttcgcctcttcacaatcattataaaatttctcaaggaacgatcagcagcccgttagctgcccctcattagagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttccggtcggtctcttcgactggcggacactccagtactgcgtaaaagtagtgttatcgccatcaatggaaggtgcgttataacgtgtcgttgtatatatgtcatatgtacctccatcactctttacagtacctttatacgttccggtaggtctgtaagtaccccatgaatccaccacataatattcgatgaggggcgatctcgtccagccatataaagtcaaatatccattgccgttcggcgcccaaactccggcattatagtttattgttctaaatggcgagcctgtagtccagcctttaccaacaacgaaattcccggtatttgaccaattaacactgtaatttccgccagagccattgactgcgtttactgtcccgcccccgtcagtccaattttgccagtaatctgtgccagctgcagaggcggttgccgaaaacatgctgatactcatgaaagctgccgttaatcccactaagaatttctttttaaacttaaacatatgttacctcctatactattttttctgactttgacatgaggcagcactcgtaaatatttaacgaacgccaacgcttttgatcgttcctttcaatataatagcatgaatacatgggtgaatattaagaacaattgtaatttaattacaaagacccaaaaaattgtatgatgagtggtcttgtaccgccatagccttatttcgcagaactgagtgatttcagttgaaactctgaggaaacgttttatttgaaaaaacttttttgccgaaagaatatctgcatacagcgtcaatgctgttcgccgtattggcaaatccgaagcagaaaaactttaccgttgtcggagaagcggtataagaaaaaatcccgggcggatgcgccgggattttcctttttaatatgtattggcatcaatattattaaacgcgtcgtccacgatgccgagcgtcatgaggacaatgaaaagaacgataccgagtacggacaagccgaccgtcacgatcagatagatcccttgcattttcacgaactttgcataattctccagcatatgttcctctgtcagttcattgaactgcgccgccatctgtcccgcttcatttgccgagcgcatcagaaaaatgccggcaatgatctgcagaacgccgggaatggctccgattaaaaagaaaaacgcgcccgaaagcgccgcaaacgcgcctataataataaacaaaatacctgtcgcttttccccatttcgaaatagaaataagcgaacgattcactgattcaggtttcaaaccatggcactcctttacaaaaaaatactcacttttcatttatacactattcggtcattcttttgaatataaaatgtgttttttcaagccgtgtccgtttttatatcagaaaattcccgggaaacatcccgggaattacaaaatcggcgacagaagtcttgaaatcgattctttaatgcggatccgcagcgaacgctcctgatattcttcatacgtatattttctggagacgagcagatcttctttaaatgaggaaatgagttttttcgcgatggtgacgtcataaataaaggcgttgacttcaaaattaagtctgaagcttctgacgtcgatattcgccgtaccgactgaagccgtctcatcatcgacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcaatgcctgacagacaggcgatcctgagggcatccaaaagacttgagtcaggaataaagtaaggcgtctgaatcaggatcgaccgtttggccgttgagatcatcttgatatagccgtttttaatttgttcccattctgaatccggtccgctcgtgacaatctgcatcccgacattgcccttcggctcgcattccggaaaatgattcggaacgtaagtgagcgtatggtgatgggaagcttggttccaatcgagaataaaccgtgtctgaatggcgtgtaccgccgtgccttgaagtctgaggtgcgtatcgcgccagtagccgaatttcggattcaggccgagatattcatctccgacgttaaagccgccgacatagccggtttcgccgtcaatgatgacgagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacctttacgccttcccgtgcttttttcactaaggcatcgcgcaatttttttcccagttcatcacctttataaatatagtattgaaggtgaatgtgatcttttgcgttggaaatgtccttcattaagcgtttgaacttatcgcgcccgtccgttaaaatctccaccgaattatcctctgtaaagactgcgtggttgttcatgacaagcatatagatgaggtctttattatccacagtcgccctgttgttaaattggaattgcctcgacttcagatctttcagctgaaacttcagcagcttttctattccgatttttttacggtcttcccattgaaacagatgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgggtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttgattcaggccccttccgggagaggagctctcgtatcggccggcatttttgccctccttgcggctctgggtcttgcgttttttaaggaagccggctatcagcggaaacaggtgcaaaaaacgatccggctttatatgctgaacagaatcagaaaaagcgatattctgtccgaggaacggaaaagcgcctacacccggctgattgccgaggagccgtctgcgatgaagagctttattgaatttttaacggaagaagaccggaaaaaagaaatgctttattaaaaaagagctgacgcgcgatcagctctttttgtcattcaaacacagggtcgttctcatagtaatatgaatcaggcgtgtcatacgtatcagtgctgtaataagccataattccgatgacagcgaagatgacgactaaaataaaagcgagaatgcccagtaccacactggatgccgcgtaaaaaaactgcattttgataaatgacgcgtaatgtgcaagcatattttcttccgcgttttcttctagtccttcctgaagggcggcagccgcttttgccgagcgcatcagcatgacgccggaaatgatgagcagaacacccggaatggctccgagcagcgttacaatggctgacagagcggaaagagaacctgtgatgatcagaaacacggcggtgatctttccccatttggcgatgtcggcaagggaacgggcttttttattgagcggctggttttcgtctttgtctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcagaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcaaaaaccaatccatccggtctgcgggcgtcacttcttccgtatcagccgttaccattcgtgaggcaatcgtcgagttgtatatggccaccaccgcatctaaatcctccaatacggctttgcgcagggttaaattcatattccgggatctcccttcacatttcattacataattaagtgcaatctgcacatactacttccaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggcggaaactccgcgtatgacagcggcaaagacgatgccgtcgaagtaggcaagtcaatggaaaacgtcgcaatgccggctgctcattctgaaaatgtttctgttgtgaaaaagttttacgaatctgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagacccggtactggggtatgtggttgaaattgaacactcagacggcctgtctactgtctatcagtctttatctgaagtcagcgtggatcagggcgacaaagtaaagcagaaccaggtcatcggtaaatccggaaaaaatctttacagtgaagaaagcggaaatcacgtgcactttgaaatccgcaaggacggcgtagcgatgaacccgctcaattttatggacaagccggtaacatctattgaaaaagcggcggctgaagagaaaaacgctgtgacagaagaaacggaagggtcaattcagcagtcttccgagaaaaaagatgtgacgcctaaaaaagaaaccgaagaaaaaccaggtgacaaagaagacggcacaaaagacaagacagatggtaaagatgacggctcaatgaaagattcgggcaagtaatcttgatcccaaagcgtctatcagctctgataggcgcttttcatattgctgcatgtgcctttatactaatagaaaacgaaggagatgctgaatgaataaatgtctggcggccgggtggctcgtctttgttttcgtttctgctttgactgaaagctttcacgatatgattgtgtcgcagacggtgtccttccgtttcacgtcccatccggatgtgtccggtttctttgtgttcgatatggcggagctcgccataccggaagcggcgattcaaaagctcgggcacgcgttttcattttttgtgctcgcctatttgtttttcagggagcgcaggcgcatgaagagggcggtgctgtatgcattggccgccgctttcctgacagaaatcgtccagctctttttcggcagaaacggatgcctccgcgatgtgctgattgacagtctcggcattgccgcattctgtgctttacaaaggaaaaagcatacagccaaacatacaaaaaccggcagtctgtgacagacgccggcttttttttatatattatggtttgtcgatttgcttttatgaacgatactttcatagattcgcacgatcagattgacaatcggacgaagcacatttgaaaatctgaacagcaggaatccgacaatgagggaaacgataatgcttccgagcacatcgatcggataatgatggccgacccaaattcttgagaagccggtcaaaaggccgaaaatcacaagcggccagccgagttttttgttgcggaacagaatcgcaattgaaatcgccaaagcgcctgtcgtatggtcactcggaaatgaagcatccgcggcatgagggatcagcgtatgaaccgtatgctcgacaaaggggcgctgctcgacatagactttcgtgatgaggtagttgatgataagcgccgcaacacccgtgaagcccgcgtacagggcgttttgtctgccttttgtgcttccgaacagccacatggcaagcaggaaaagggcgtaggcgtaaatggcgtattccgttataaataccatgatagagtcgagaatggcactatggtgcgacaaaccattgatcgctttaaatagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaacgccgatctgccgcttgtgtttgtcattatgctgctttgcggattcggcttgttaatggtgtacagcgccagtgatgtgatggggtctcagcggtacggaaatccatcctatttcttccataaacaaagtgcctctttattgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccgcttgtcgtacagccgtctgaattggcgaagatcgccatgattttgtatttcgcttcgatttatacgaaaaagcagccgtacattcatcaatttgtgaaaggggttctgccgcctttagtgattttggggaccgcttttctgctgacattggcggagcctgatttagggacggcttccttaatcctggcggcgtgcgggtcgattttattatgtgccggcttgaaaaagcgccatctgttcgtgctcggcgcgacggcggtgtcgggggttgtttatctcgccttttctgcttcctatcgtgtgaagcgcctcgtttcctttaccaatccgtttggtgacgcgaacggggacggctatcagctgattcaatcctattttgctatttccggaggcgggtttttcggaagagggcttggaaacagtgttgaaaaaatgaactatctgcctgaggcgcataccgatttcattatggccgtgatcagtgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtcttgaatttgggagcgatgagcggactcctcccggttacgggtgtgccgcttccgtttatcagctatggcggttcttcattgattatgacgctgtttttgtgcggcatactggtcaatatcagtacatatgcgaaaaaacaaaccgtacggcataagcgtcctgccccgcatgaaaaaaaggcttcttctttttaatgaagcgagaaaaaacgcccgggatatttctgtctccgggcgttctgtctgtttataaagctcctggtccttcttctccggtgcggatattaatcgtgtttccgatttcatagacgaatattttgccgtctccgggctctcccgttttcagcacttttttcgccgtttccacgacttgatcaacggggactttgctgacaacgatttccactttcagccgttcatacacattgctttcaattttgactccgcggtacagttcggtgtgagctttttgaaggccgcagccgtgtacgttggagaaggtcagcgatgtgactccgattttaccgagttcctgttttaatgtttcaaacttagccggacgcgtaacgatttctaccttgaacatttgaccgctcatctaagccactcctcactttataagtcctgatatgctttttccccgtgcatcgttaaatcaagcccaagtgactcttcttcttcgctggcgcggaggggaatgaacagacctacaattttaatgataacgaaagtgacaataaatacaaatacgtaggttgccgcaatggctgcaatctgcttccagagcagtcccggatcgccgtaaaacagtccgtttgccccgccgtcattgacggaagtggtggcgaataaaccggtcgcgatgccgccccatgtcccgccgattccatgcaggccgaaagcgtcaagcgcatcatcgtatccgaaagtctttttgagccaatacacgccccagaagcagacaagcccgccgatgaaaccgattacgatggaagagaacggcgtaacgaacccggcagccggcgtaatggcgacaagcccggcaatagcgcctgacacagcacccagcatggtcggttttttattcagcatccattcgattaaaatccagccgataattccggctgcagccgcggtgtttgtgttaatgaaggcaaacatcgcgatactgtcaagcgtgagggcgctgccgacattgaagccgaaccatccgaaccaaatgagcgccccgcccaagaacgtgtaaattaagttgtgaggcgaagccgccgtgccgtccttgcgtttcccgagcacaatcgccagcacgagcccggcgaccccggaagaaatgtggacgacgtttccgcctgcgaagtcaagagcgcccatttggccgatccagccgccgccccatacccagtgcgcaacgggcgtatatacgagggaagcccataaaaaggaaaatacaagaaaagcactgaatctcatgcgttcagcaaatgctccggaaataatggccgtcgtcagtacggcaaacgtcatttggaacatcatgaataatgaatgcgggatcgtatcactataacttccgggttcaaagccgacccccttcagtccggcccattcaatcccgccaagccatgtattcccgggggcaaaagcaagtgaatatccgtacaaaacccaaacgacggatacgatggcgagggaagaaaaactgtgcatcgccgtgctgagcacgtttttgctttttaccattccgccgtaaaacaaagccagcccgggggtcatcagccacacgagtaaagcgcaaaagaacataaatactgtatcgcccatctgcatgttgtattcctccgtctcattcaaaatgtaatcgtgattaattcattattatagagaaaaaagaacgataaaacattttcgtgtaaggttatctgacatggttttttgcgttcataatgtcgctttttcaaaggggtgtcatgcgactttatatccataaaaagagagccggagcatggcggaagaaatcctgtccgggaaagagtaaaatatacggggtgagaaacactaactgcatcaggaggaatcattatgacaacatcattgaatctgcaatttgaaaaaacggctttggtccttattgatttacaaaaaggcattgtgccgatggataaaagcggtaccgttgtgccgaacgcgaaaaaattaattgatgtgttccgggaaaaaggcggatttatcagctttgtgaacgtagattttcatgacggagcggatgcactgaagccgctgacggatgaagaggcggcgggccattcggctccgccggcggattgggctgaatttgtgcctgaaatcggagtgaaagaaaacgattatacggtaacaaaacggcagtggggcgcgtttttcggcacggacctggaccttcagctcagaagacggggaatcgacacgattgtgttatgcgggattgcgacaaacatcggtgtagaaagcacggcgcgagaagcttttcagctcgggtatcagcaagttttcgtaactgacgcgatggcgacattcagcgatgaacagcacgaagcgacactcaagtttatcttcccgaaaatcggcagaagccggacgacggaagaatttatcgcacagacaaaatgacaatctccaaaaaaagccgcgtcctgttcttgacggccgtggcttcggggacgatgctgaacccattgaactcgtcgatgatttctcttgcgcttcacagtattcagcatgaatttcacctgtcgtttacaacggtgtcctggctgatatcgtccttttatcttgccagcgcggtggcgcagcctgttaccgggaagctcggtgatatgctcggcaggaagaagctgtttttgatcgggcttctgcttgttgccgtctcggcggtcggcgcgccgtttgcgccgacttttatgacattgctgatcatgcggctttttcaatcgatcggaagcagcgcgatatatccgtccggcgtcggattgatccgttcaaatatacaggagaagcaggcttcggcgctggccgtcctgtcaatctttgcatcagccatgacggcgctcggtccgactctcggcggttttctgatcgtttggggagggtggccggcgatctttttcgtcaatctgccgtttatcatcctcagcttttttctcggaatgtatatgtttccgaaagatgaaaaacgcgagatcggcggcttgaaaggcgtgctccgccagcttgatacgatcgggatacttctgtttgccggagcgattatccttctcctgtcgtttttattgtccttcggtacgaagcctcactatacagaaggcgtattcgggcttttgttcgtcgggctgtttatctggcgcgagctgaaaacggagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcggattgattatgctgtttatgtcgggcatgagtattctggtgtcgcctttgaccggaaaatggatagataaaaaagggcttcttcagccgattgttgccggaacctgcctgaccgcgatcggagcggtgctgttaacgtttttcttccttcaggcgcccatgacaggaaaagggctgatcctgtccgtgctgggtgtcggctacggcttcggaaatgtcacgtttcaggcggccatgctgaaaacgagccccgccgacatggtcggaacaacgtccggcctgtttcagacctgccggtatctcggttcgattttgtcttctgtcattttgggcattcttttcgggaaagaaattaccgccgcccattttcatatgcttgggacgattcttatcgttgtcggcgccgtaagccttttgatggcgttccggttttcggttctcctcaaaaaagcctcttaacaggcgcgaaaaaaagagacgggctctccctgtctctttttttgtgtaatgtgctcaaaaatcaaaacgattattgtcgacagcgaccaatgttatttgcggaattttcagttatattttttcacatgtgatgtaaggaaaacgtacatgcgggagggagaaaatgacaaaaataacgagtgatcggctaagcaacaaagatttactgcctttagaagacggcgaacggacatggaaggcggtgaattttgcatccatctggatgggttgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccttttccggtcattatcagggcttcttacggaatatacggcgctaacattccggcgcttctcagggcatttacagccatcatgtggctcggaattcaaacatttgccgggagcactgccttacacattctgcttttgaacatatggccgggctgggggagtctcggcggagattggaatatattcgggcttcatctgccgggctttctgtcgttcattttcttttggggcattcatctgcttgtgctgcggcacggcatggaatcgatcaaaaaatttgaagtgtgggcgggcccgcttgtttatctcgtcttcggcggcatggtctggtgggcgatagatattgccggcgggctcggtccgatttactcacagccgggaaagttccatacattttctgaaacgttttggccgtttgccgccggagtgacgggcattatcggaatatgggcgacgctgattctgaatatccctgacttcacccggttcgccgcgtcgcaaaaagaacagattcgcggccagttttacgggctgccgggaacgtttgcgctgtttgcgtttgcaagcatcacggtgacatccggatcacaggtagcattcggagaaccgatttgggatgtggtggagattttggcgcggtttgataatcctttcgttatcgctctttcggtcatcacactttgcatcgccgccgtctcggttaacgtggcggcaaacatcgtgtcaccggcctatgacttggcgaatgtcctgccgaagtatattacattcagaaggggagggtatttgaccgccgttttggctctgttcacaataccgtggaagctgatggagagcgccacgaatgtatatgcgtttctcggactcatcggcgggatgctcggaccggtggccggggtgatgatggctgattattttatcatcagaaaaaggcagctctcagttgaagacctttattcagaaaccggacagtacacttattacaaaggctataattaccgggcctttgccgcaacctttctcggcgcgtttatttctttaatcgggatgtacgtcccggcgttcgccggcatctatgatatttcctggtttgcgggtgtcattttgtcatgtctcggttatacggcgcttatgtacattcatcctccttatgcaaaagcggaggggcgaatcgtgcgggaaagagcggccgaataaaaaaagccgggggctgcccccggctttttgtcatatcagtctgcgattgaaacgtttccgtccgcttcaagcggcgttctttttttctggctccagccatacaggagcaaagcaatcaggacgaacagccccgctgccagataaatcgaatggaatccggccgaagcgacgaagaggccgaatacatatgacccgccggcaatcccgctgtcaaagaaagtgaagaaggtcgccgtcgcaaagcctgaacggtgtccgggcgaattctgaatcgccagcgtctgcatacacggtacgatagagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcacggcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaacacagtcgttccgctgttgttttgatccggcacacgaatcataaaagcaatcagcaagcctaaagaaacaaatacagcaaaaagcgtaaagaaaaccgggaacgatatgactttcacaaggctcagtccgagaaacggaccgatcgccatggcaaggttcatagacatcgcaaagtaaccgagcccctcgccgcgccgcttggcgggaataaggtcagcggcaattgcgcccgtgaccgtcgttaaaatgctgaaccagatgccttggaaaaaacgcagtccgagcagcagatagaaattgtgtatcggcaaatacagataagaagacagggcgaacagcgccagagatacaatcgtcattcttttcttgccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaattcacgagtacgaccataataaaatctttggtccagatcgagtcagatttactcaaaagtacagcacttccctttctttattatttcgttaaaaacacattcagaaactcagaaaaagcttccttatctccatcttggaaatccgcaagcatgtcttcctcgaacttcagcatctcttgattgatgctgttgtatttcaattcagcttccttcgtcaggacgacgagcttttcccgcttgtcttctccctgttcccgctgaatccagccgttttcttcaaggcgtttgatcgttctggtaacggtcggcgcctctacgttcagataggaccagatttctttttgggtcatcggtccgatcgtttttaagcaatataggattgaccattgagaggagtacaggccgaatggttccagccgttcattggctttcttcgtaatcaggcgggcgcattgattgatttggtgaatgaggcgtctgttgacgtggatcatttccgttctccttttcaaaaaacttacctaagtaactaattgtgctgtttcattctacagcaggatcgcgcggatgtaaaccccccgttcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatctgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacagaacgcctgcctgaaatcaatcctgacttggcgaatgaagtaaaagaaatactcgattatcataaatccatcagacatttaagggggggcgaggcgacaaaattaaagtacaagaaggatgaaattcttgaaggggagcccgttcagcagccgtagcgcctgacgtctgccgggcccttttttctcctccgggcggtttcgcgaatatccgcaaaattttgtcaagaacttatatcgttcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaactgaagctatgctgaaacatttcattaataagctgaatgtaaaaggacttttctcaaaaccgcgcatgctgatctgctgcccgacgaatattacatccgttgagcagaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggtctgccgagaacgattacagtaaacagcaaagaagtggaagaagcccttcgtgaatcagttgccgtcattgtgcaggccgccaagcaggttcttgaaagaacaccgcctgaattgtccgctgacatcatcgaccgcggcgttatcattaccggcgggggagcgctgttaaacgggcttgaccagcttcttgccgaagagctgagggtgcctgttcttgtcgctgagaacccgatggattgtgttgcggtcggaaccggcgtcatgctggataacatggacaagcttccgaaacgcaaactgagctgatgataaaacctcattctgaaaaagaatggggtttttttctgtcaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacgtcaggatacaaagaggatcaaggttcaatccgcgcctttcccgagatgcttctgagccgaatagaaggcgataaaaaaacgaaaatcggttccgtcaacacaggcgtatacatgcaggagctgaaaccgttgtttacgcagggaagcctgaaaacgaccgatcagccgacggatatcgcgcttatggagaatcaggttcccaagaatgccgaaacgaatgaaaacgccgagctgttttatcccgtgcagactgcgggcggcgtccgctattcaaaaagcagcactttctcattaaatgaaaacaatcagcttacgataaacggaaaccttgttttatcaacaaacggacagccgattacagtcgacaatgaaaaattcaccgtatcagaaaacggaacggtcacgacaaacggccggccggcggggcagattgacatcagaatggaagaagacgtgcgcaatctgaaacgggacggcaatgacctatacagcacggccgacggctctgaactgccgagcgcggcggcgaatccccaggtctcgtattcattaaagcaaggcgtctcggagctttcgaacgtggacgtgacgagcgcgtatacagaaatgacggaagcatacagatcatttgaagccaatcagaaagtcattcaggcttacgataaaagcatggataaagccgcaaatgaaatcggcaaagtgtaacaaaatgggggacgttcaattatgatgctcagatcaatgctgacggcttcaacagccttaaatcagcttcagcagcagatggatacagtcagcagcaacctttcaaacagtgatacgacaggctataaagcgagggactcccgcttttccgagctgatcagacagcagtatgaccatatagatgacaaaaaggaaaattcgccgaacatgcggaaaacgccgcccggccttcgtctcggcgccggaacggtcatgactccgcagctggactcaggtcagggcagcatcaaaaaaaccgaccgtgaccttgatatcgcgttcacctcaccttatcaatatcttcaggcagaagcggacggacggcgggtgtatacaagggacggctcactttccctcaagccggccggcggaaatgaccgggtgcttcagctgatgacagcgggaggcaatcccattctcgatgagaacggccagcccatacaaattgacagttcgctgaatcagctgaaaatcagcaaaaccggaacgctgactgcttcagaccaggcaggaacccgttcgcagacgtttaatctcggcatcgtcaatgtcaataatcctcaggcgcttcatgcggaaggggataatctgttttccgtaaacggtgcgggggcttcagcgattgaagagcttaccggcgcaaaccggcaggcaatcggcatggagcagggcgcgcttgaaggttcaaatgtcgatatgtcaaaagaaatgaccgacctaatcgtgtctcagcgttcctatcagctgaacagccgcacgattacattgggagaccaaatgctgggcttaatcaactcagtcagataaaagaaggggcgttttgatcagccgcgcatgataaaaaatgcggctttctcaaaatcgcccttttttttgtagtaatcagtaatatcctgaagcagcacttccaaatccacccacgcttcaattttctgcagctccagcacgagcttctgcaatcggtcgtacgggtcctcctgagcggtgtacagtatgttgagcgcggtcagcttcaatttcataatcttgttctgcactttttcagatatgtataaacctttctgcagcacggtttgtccttcggcggcatatccggttttaaaaagtgctctgaccgcttcgtatacacaatgcaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattaaagagctgttctgcgtcttcatagcgtgcctcgtctatgtaattcacggcgagaagcagccggcagctgagcgtttttttgatgtagccgaattcaccttgatagatttccagcgctttattgacatattgaatggagagcgcaggcgacttcatcatgtaatatgcacccgctgttttataataaaattcagcggcttcgaaacggtcctgaatggccggcaggtactgttcagcttctttaaagcggcagacagcacggttcggagcgccattcaccatatggaataaccctttgaaaaaatagaaataataagttaattcatgatccatctcatctttgcgccgcttcagctcgcagaacaatttagtcagaccgtcttttttctcaaacagcagctgaaaccgtgcgaaaaacagctgatatctgagtttgagctttgcgttcttttgtaatttggggagatgctgattgatttgttcgtgaagggaacgggctagatcgaattggcgttttcccatggcgtcataccactcattcagcatcaccagcgtacgtttttcagtaaacttagcaatcatcttccaacctctttgcatagggtaaaaatctttatttatcataacacattaatggacgaggctcattgccagctggttacagtttacagcgcggttgaaaaagaaattgattcataatatacttccaaatgtacagattggttagcgcatataccttctatacatactattgtcgatgaaggagatgtcaagaaaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtcttaatcgtagaggctttggcgcaggtcggagcggttgcgatgctgattaaagaagaaaaccggggcagactcgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacatttgcgctcggagaataaaaacaaacgaatgggcttataaaaaagcccattttgtatagaaaggggtgaatgtaatgtggtcagaatttaaaagctttgcgatgcggggcaatatcatggatctggcaatcggtgtcgtcatcggcggcgctttcggcaaaattgtgacgtcgctcgttgaagacatcatcatgccgcttgtcggcctgcttcttggcggtcttgacttttcagggctggccgtgacattcggcgatgctcatatcaagtacggaagcttcattcaaacgattgtgaacttcttcattatttcattttctatctttatcgtgatccgcacaataggcaagctgagacgtaaaaaagaagcagaagaagaggctgaagaagcagaagaaacagatcagcagacagaactgctgactgaaatcagagatctgctgaaacagcgggctcctcacaatgactaaggcacaaaaaaaggctggatgattaacgtccggccttttttatgattataatttttgtttaaacgcttcaatcagccggctgcccgagtagccttctttcacgagcgactccagaatgctttctgatccggggtggtttcttgacaccatttgaccgtaaattaaaacttgtatactcttttccagctccacaatatttttgatgcttcccgtcagctgggcggggcggttgctttttttcgtaatcgttacaaacaccttcgcttctttctggcttttcatcagcatgtcaaaaaaagaaaagtgttcggccgggaccagtgcttcaattaaccagtggttttctccgtcctctttgttgataatcaatccgtctaaaaggggaaactgttcaatcggctgatcgtctttatctaaacgttccacattcagatcaaccagtttaaaggttttcatctcttattttcacccctgttgtccatgtttttcgttcatttattataacacatatcatttttcccgggaaaatgctgtaagacatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcattgactgataaaaagctgagtttttactggttcgcatgggacggcggaaagtttgtccgcatgtttgagaaagactggctcaaaacgaaacttttctcgcggctgctcaaaaatacatattacataagcggtcaaaaacaaaagttttttttatcagaaagaaaaacaaaaacataaaagcagcccaaacggataacggctttttccgctttttgctttcataagcctttgtactacaatgaagccagcctcgaaaaagagaggaggagacggcttgtttaaccacgttatgcttgtcggccggctgacgaaagacccggagctccgttttacatcagcgggcattcccgtcgctcatattacgttggcggtaaaccgcaattttaaaagcgcgtcgggtgaaaccggaaccgactttgtcaactgcaccatctggaggaaaaacgctgaaaacacggcattgtactgccaaaaagggtcaatggtcggtgtaagcggcagaatccagacgagaagctatgaaaagacagacggcgtaaaagtttatgtgaccgaggtcatggctgataccgttcggtttatggatcaaaaacggaaagagccgctggctgaatagcatgcttttttcctcgatttcccgcctttcagcgggccccgcaatacctccttcccattcgccagtcgaaagactggtttttttgtgcgggagctgaaaaatggttaaaaagaagtgatttcgcttataaatacttaaaaacattgaatatattgggataaaaacttataattacttacagataagtgacgaaaaaaagggaatgaggacgtgtatcaagaagaaagactgattgcgataatggaatatttgaaacagcaccggcggatcaccgctgaacagatatgttcgctgcttcatatttcaagagataccgcaagaagggaccttgtaaagctgaaagagcgaggggccattatcagaacacggggcggcgcgattctgccgtcagtgaatcaggaagttccgggctattcgggccggctgaaaaccgtttctgaagagaaaaacaaaatcggcaagctggccgcatccctgattcataaaggagaccggatcatcctggacacatcgacaaccgttcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgttgtagaaaaactgggggattatcacgctgataaggtgctgatcggcgttgtcggcatctcggaaaacggcctgacgattccgcatgaagaagacggcatggtaaagcgtaaaatgatccgtcaggctgaacaggtgattgcgctgagcgatcactcgaagcttggccgtacgagtttttatcagtatgcagacctgcacgaggttgacctgctgattaccgatcggctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagcgatgaaaacaagcgggctttaagggaagcccggcaagcgggaattgaaatcgtggtttccactggacgcgcgcattttgatgtgcactccatattcgaaccgctcggcataaaaacatggattatcagcgcaaacggagccgccattcatgctcctgacggcagcctgtaccattgtgaagcgattgaagaaacaagagcccgggggattttgtcatggcttgaagagaatcaatattattatgaggtgtttacaaacaaagccatctatacgcctgaaaccggcaggcagctgctcgatatcgaaatggaccgggtgaaaagcgccaatccggaaaccgatctttccgttttggaacaggcggcttcagtgcaatacagccagtccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaactttgaagtggcgtctcgaaacgcctcaaaagggcaggcgctcaaacggctggcgcaaaagctcggcattccgatggctgaaaccgccgcggtcggtgacagcttaaatgactattcaatgcttcaggcggccggaaaaggcatagcgatggggaatgcgagagaagatattaaagagatcgctgatgccgttacattgacaaatgatcaaaacggcgttgcgtatatgatcaggaatttactgtgaaaggtatggcgatactgttcatgactggcgtgacgcattcatggcaaatgcggcgtaacagtaaggacgacataaaagaccggctcttccgagagagccggtctttttgcgtttaatgtgattgcgccgatgcgctgagggtgaataattcttcaagctcatcggatgacagctcggtaatccaattttcactttggataatctgatcgttcaaagtttgtttcgtttcgagcatggcatcaattttttcttcaatcgttcccgtcgtaatgagtttgtgaacgtggacgaaccgttcctggccgattcggtaggcgcggtcggtcgcctggttttccaccgccggattccaccacctgtcatagtgaatgacatgattggcagccgtcagattcaggccggttccgcccgctttcagtgacaaaatcagcgtcgggtattctttcttctggaaccgttcgacgagggaatcgcgttcctgcttggacaggcttccgtttaaaaactgaaccggttctccgaatgttttttccaggaggcgcttcatcatgttgcccatctgaatgtattgggtgaaaatgaggcagctttccccttgtccgcggatcgccgccattaagtcaagcagcttttccagtttgacggacctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttttcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgattgcgcgggactgcttcgtatgcgcgtttttaatgttttgcgcttcatcaaggcagacggtgctccatgtcacggaagaaagctcttcctgatcggcgtgcgagaggccgtaagaagtaagaacgacatccgcgtcctgataggccgggacaaatgcttcccccttcggcctgcgggggccgtaatgaagcacggccttcagctgcggcgcgaaggtctggagctcacgctgccagttgccgagcaccgatgtcggcgcaatgattaaggcaggcgctttttgccggccgctttccttcacatggagaaaataagcgatcatctgaatcgtctttccaagtcccatgtcatctgcgagacaggcgccgaagccgttttcccgtaaaaacagaagccagttcatgccgtacatctgataagggcggagctggccctgaaacgcggcgctgacttcatgctccggcagatccccggcatccgtcagtttgcggatcaggcttctgagatgctttgataattcgatcttgattccggcaaatgccgatgagtcaatgatgtccgtgtcctcggctccgttttccccgtgatccatcagttcgcgcgccagcacgtcggacatgtggaggccctcagattccgctttttccatcagtattttcatctgtttaataaattgcggatcaattttcacccattggccgcgaatgttgacgagacgtctgttgtttgcgacgagctcattgaattcatcctctgtcagctcaatcccgtttgtggcgaatctccagttgaaatcaagcagagcgttcatgccgacgaaggactcgccccgcggggaggatgacactttcgccttaagcatcatattgctgtcccggacaatctgccaccatgatgggagaagaatctccacacccatatcgacaagcgtctcactcgcttccgataagaagatccaagcctcttcttcagatatcagcgtcgttcctgaatcaaacgaaagccagtgaaccgttctgcggaagcggtcctgttcacgcgcgatttttccgctgtatgcctgccacgcttttttcagccctttcagtccgtcgaaaaaggtgatggagccggtttttttctcccgtaaaaacatctcgattttccagtcgtcaccgtcgaaatcaggctcgtttaatcggaggccgacggtaaacggcgtcagatcgtcatgccagccgattccctccagaaaatcctcttcatccaaaaaggagcctttaaacgtatgaacggccggcgaacgggtttcgatccgccgccatttttccagcaggtcatcattgtactgaatgtagtcctgtaccgcggctgagaaccagtctgccgtaaagccttccagcaaaagctcgcggtctttgaagcgcaggacgccattttgccatgcgtcataatccggaagaaaatcgccgtcggcaataaattcgtatatcgtcgaagccgcttcgattaacggttccgtttcctttgtcagctgcacggtgctgaatgaattgaacgagttttttccaagcagctcgacggtcatccaagggctgagcagaacggccggagtgccgatgaagctgacgtcttcaagaaacgttccgtaaaaggtggactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtagcttgcgctcagccggctgatataacgctcccatacctgctgtttttttgcctttttataaagcgtccgcagttttttcaggtggcgcgcagcctctttataggcgctgcggtttttttggtcgataaaaaaggccgccgcccggtgataggaggggatgagcgcttccggatcactggcggcaatttccttcaggatgtccttttcaatttcccagacggaaaaaccgacgaggctgtgaatctccacccattccgcgtaccgccgtttttcgtacaggtactggctgtattcggtaaaggtatagggaaggcagccggaagcaaaccgttcaaacagctgatcatcccgtgagtgccgcgcataatccgccaacagtgcaaacagctctccgatgatgtcgcgcatttctttaaacggcttatcaagcttcgtatagttcacggcaagcggttcgatccggccataccatgttttcagccgtttccagtcttttttcgcggtgagttcaccgagccattgaaaagtgtacggcagcgcttcaggagggaagcgggacatatcttcaaagaccgcttcatcatctttttgcaaaaaggccagatgaagccgtccgaaccgcacttccggcgaaaaacggcgcccgctttcctgttcgagaatctcctgttcacgcgcgacccatttcggccggttcaaaagcgcgctccacatttcaccgaatacccggaggcgttcgtattgaaaaagctcttctttcacaagcagtctgcggagcaccgggggcgtccggtctaaaaaaggatcgagtgaaaaagacaaggcgtacgttttcagtctgtcaatggaggaataaatcgtatccatcagctgttccacgtatggattaatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctctcctcaagcttttctctttccagccaatgttcggtaaaggtaccgacccgctcgaattgggcatatacgtaaagaaaaacggcgagcacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacatcggtgagcagtcctctgagatgaccacaaaagaaatgcttgagaatttgatttcttatattaaaaatggatatgcaacataaaatcccgcagcctcctggccgcgggattttttaatcttcctgtgacaccagcatttaaagcgcttacaaatataaatcagattgaagtgattgtctatttttgtcgaattttgtcatttgaaaaggttagaaatgacagtttaaagctgtataatcgtaattggaaaagatcattggagggaatgggaatacacggaaagtgatatggaggttatatgggagaatctgcaagcataaaggaaatattcgcaatactgagaaagcgtctgctgtttatacttattattaccgcggcggcatcttccgcaggcggtctcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagcccggtcatcctcgatgaggtgattaaacagctgcatctgtccatgacttcgaaagagctggaatcgaaaatcacggtatccagcgagcaggattcacaagtcgtgacgattgccgttcgggatacggatgctaagcgggcggccgttatggcaaatgcggttgcatccgtttttcaggacaagatcaccgccatcatgaacgtggataatgtcagcatcctttcaaaggccgaagtgtcggacagccagtcaccggcagagcctaaccgtaagctgaacatcgcgattgcgtttgccgccggacttttgggcggaatcggtctcgcctttttgctggaacatctggataatacgatcaaatcggaagaacagctggaagcgctgctcggcatcccgatcctgggaacggttacttcaatcagtactaaagacagcgttgccaaaagcttgaggatggcggaaaccaaacaagcgggaggcggacatgttgacgcgtaaaaaagacaaacccggaaaacgaagcgtgattgcgatgtctgagccgaaatccatcaactcagaacaatatcgcacgattcgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatctgcgcaaaccgacggttcatttcaccttcaaattggataacggaaccggattaacgtcgctgctgttaaaacagatgccgtttcagaatgccgtcctgccggctgatgaagcaaacttggatattttaacgagcgggccgatcccgcccaatccggcggagcttttatcgacgggtgcgatgaaagatcttctgtcagaagcagccgcagtttatgataaggtgattttggatacgcctcccgttttggccgtagccgatacgaaaatattaggcagctacactgacggagccattatggtgatctcaagcgggaaaacggacaaagaaaaagcggccaaggcgaaagaagcgctcgattactgcccgtgcaagctccttggggccgttatgaacgggaagaaacaaacgaaacattcggactacgcctattacggacaataatgtcacaatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggatcggcatacggtcaacgaagcggtcagcctgttaaacaaacgtttgaataaggaaggcattccgctgactgttctgccaggccaggagatcagaatagacggagatctgctggcaggtcttcaaagcggctcgcttgccccgctccataatacaaagtatgtgctggcggaatttccggcggatcatgtcccggcctatgctgaaaggctgttttatgaactgcagctgaacggatatgtccccgtcatcgcccatccggagcggaacagggaaattcgcgaaaatccttccgtcctttacagtcttgtgaagaaaggggcggccgcccaagtgacggccggctgcattgccggagcattcgggcggaaagcgaaatccttttcgctgcagctgatggaagcgaatttgatccactttctcgcatctgacgcccataatctcggaccgagaaatttttattatcaggaggcgatcagcgttctgaaaaaagaagcaggagcggagctgatttacatgctcacggaaaatgcggcgcttctcgctgaaaacaaagccgtttataaggaacctccgctgcctgtggcccgccgtaagcgctggggtcttttttaatcgtcgtctccatcccgtttaaatgaagcgtaagcggctgttttgcaagatgattcttttatgcttatgctattatcagcggccggcgccgttttttcctatcatgacctcaggctcccggcattccgccggcgccgggatcatatgataatagcggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgacgaacgtaaggttgagcagatgagaaagggattgtcccctatctttgaaccgggccttgaagatatgatgaaacgaaatatcggccggcatcggctggcatttgaaacgagctacgaaaaagggcttgcggaagcggacgttatttttatagcggtcggaacgccgcaaaaagaagacgggcacgcaaaccttacttatattgaaaatgtcgccgaacagattgccgaacatatttctaaagatgcgatcgtcgtgacaaaaagcacggttcccgtgggaacgaatgacagaatcagcgaagttattcattcacggctgagagcggacgtgaacatttcaatcgcttcgaatccggaatttctccgtgaaggttcggcgattcacgatacctttcacggcgaccgcatcgtgatcggggctgaagaccggcagacgcgggaaacgcttgaccgggttttcgcgccgcttgcgattccggtatatcatacggacatcagaagcgctgagatgatcaaatatgcgtcaaacgcatttttagcggcaaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctgggcggtgtgacggggaaaaccatcgcgttattagggctgtcttttaagccgaatacagatgatatgcgggatgccccgtccattgtcattgcggatcgtctggcggctcttgacgcccggatgacagcgtacgatccgatcgcttcattccgggcttccgggctgcttccggctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggccggcgtggaatatatctcaatcggaagaagagccgtcgtgcctcagactgattctgtcacttgaaaggccggcggtccgcgccggccttttatcatacaatcattagagacgaaggagatattaatcgtggaaaacacatggaaattgccgaagcaaatggaatcatcccgcggtctgctggaaacgtcagcacggccctttatcaaactgcacgtcaaaaaagctgaaacgggacggtatgacagtaaaattgccggagacccctattttccgaaacatgaaccataccctgaagatgaaagcggcaggccgatgaagcttctcgcccaaatcaattttgcggatatgcccggactacctgattttccggacaccggcattcttcagttttacatatcggtcagtgatgacgtatacggtttgaattttgacgacgggtgcgcgcaaacgggtttctgcgtcaaatattttgagcacgtgacagatcgggaagaggagctcatggatgatttttctttcgttcaggttgaagaggagtacgattttccgattcaatccgaagcgctgatcacccctgagctgtctgctgaatgggtgctcccgtctgattttcaattcaggcaatatgccgggatggatgccttcggctatttcgagcagtttgacgatgaggtgtatgacgaatatacggtgaacgcattcggccataaaatcggcggctatgcgtccttcacccaggaagatccgcggtcttattcccatcaaaaccatacgattctgctcttgcaaattgattcagatgatgacattgattcgatgtggggagatgtgggaatcgccaatttctttatcagaccggaagatttgaagaaaaaagatttctcaaacgttttgtacaactgggactgcagttaacgacattattagaatcatgatacaaggcaaaggagacggttaatcactgtctctttttttttagggaatttatcatggatacatagaggagatcaatgaatggatatgctgtttaagtgagtcttttggcgttaatgatgagcatctcggctgctgaaaataagtcatttaacctatttaagctgctttctgtctattttaaaatataatatatggaaatatagtatggaaaagtctgtgctttttgtacgactttttgcgtaagacgaggtgaaaacagatgagccattcaagcacattaagccatattaacagcaccatcagccataaactgggcgagatcgaacaccaaattgataaattaaaagaagcgaaaagagagatagaatctctgcaggaagagggcgtgtctgaaatcagggacatcctcaggccgcacctggatcatcattggaccggcacttttgctgaagaatttgatgaccggcgcgatcaggcccatacagaagcatacagaatcgtcacagacaaatacgacggttatatttacagaatcggcttaaagatgacacagcttgaaattgaaaaaggagggctccttgccgccagaagcatcgcgagagaggcagagcacctgctgacgctgggagaagaagcccttgacacggtcggagaaaaaatacaatcaatcaaaaaaagctggagttggttttaatggcagaaataaaactcaaatacggagccgtcatgaagcagcttgaatccgtcagcagcgctttggaggccgtttctatcgggaacgccggttcaaacggaaaaaacaagctcgactatacctccaaataccaatcccgcgaggcaaagcttgtatcgatgatcagcgaatacaagcaggccgttcataagaacatcgcggacgttaaagacaacgtagattctttgaaggaacaggacgaggcgatcgctgtaaaataacgaaagaaaggacttgccgatgagcaaagtgtttgaatcacaatcgttaacggacgaagcagataagagaaagaaacaatacgaagcccttgaagaacagctgcgtgcgctcaaacaagcctttcaaggcgtggccgatctgggtgatgctttgaaagggaaaggcgcagacaatataaaggatttctttcagggacaagcggaaatcgccgacagctggctgacgcttgtctctgctcaaattgcgtttttaaatggcatttcaggtgacattaaagatcaagagctcagtgattcatatgcggagacttcatttttagagcatgagctgcccaatgcggatttgagagcttcagagattgtctccgctcataaagcagaaatcgattcgattttgtctggcatcagtgatattattcatctcgatacatatacgctggatgattacgcagataaaatgggtgatgcccagaaaaccagacgcgacacgatcacggcagtcgatacgcttgatgaatccctgaccgctgaatatcaaaacttagaatctctggacaacgcagtgctcagcaaatattcccttctcatgcaggccaccagcaacgggaaaagcgcctcccctatgtactatgacaaaaaagccttccacagcaatgaaatctacaaaagcgtcatggcgacagaaaaacagggcacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggcgttgatccggtgaccggcgaaaaactctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgacagaaatgggcgcatacggtcttgtcgcctcaaacggattctcagaagccgtcacaggacgggatatgttcggaaacaaagtgtctgaggaaaaacggaagcaaggggcgttggaagctgcgctgagtttggttggtgccggcgcattggcgaagcatgtaaacaaaggcataccgcttgcaacccattcaaaagttcaaaaagctaacaagacactagaaaaagttaaacaattcaaagtcccgacaaacgtccgcgtgtacgcagaacgcccagtaacagcgaacggctttacgtacggattcccaacagtccgtgtcgatgtggaaaagacggctgtgaaggatcttgggattgtgaagatggctagtagccagtcaaaaaaaccaaaatggttggaaaaacctgaggggatgactcaaaatgattatgttgctcataatggtactaactacagtaaaaagaaacggactgaagaatactatgctgcgctagctgatagagagaagatagttggagacaattcaaatggatatcgtttaaaagaaccaactaactggatggaagaaagaggtatgatacaaataaaagaaagattaaaaagaaaatcttggtcagatagagatgggtttaattggcaatgggattcccagcatggtaaattagaaaagtggaaccgcagaagaacagagcatttaggagagtttgatcctgtaactggtaagcagacgaaaaaaggcgagccttcaagaagatgggatggttaaaactatggaacatggaatcagatttattaatgaataccctgaaatcggtgaattgcttcatcgtctatttgtgaatagggaattagacgaatggtacaagagcaaatgcgcagagaaaataaaagtacctgatgaatttaatcaaataaaaggtttgaaaaaaattgaagttagagatttaaacaatccttcaggagaaattgatatccatttgcaagatctttctggggaaaatggttttcatttagaacagcaaatcaatatgaaagtatctaaattggttcctgtttatgtattagattatagttattccctaagacacgatttaatagatggcgcttatgacattgtaggaaccgctgaatctttagaattcattcagggaacgaactatattaataaaataatgcaagagaaagggtttatcgaactcagttatttgtatgattactacgatactgtgtatgagtggagtgaattgccacatatacagcctttcaacaggagattaacattaggagatgccttgtttactgatgtattagaattgctatagttaagagcttgccgtgttgttatcggcaagtttttttataataatttaacaatgtggaatacaaggagaagcaggctgccgatccctgtccgtctggctgaccttgaaacgcatgttttgcgaacgttttatcggaaaaatcacgtgtaacacttggggctttaagccaccaagtgttttttttgtatgcctggtgtccgctttattaaaaactttgtcgtccttgcagcaggtttttatttaaatgtttttcgcgtcaaatcgataaatgcctttaatggtgcagacatccacttgtccttatgccatgctaattgagtaaaaacggggcattcattctgccagttgagttctttcatccgtccttcggcaatatcgtcttttactgtcatttcaggcaatagtccaattccgagtccggccatcacgcattgtttgatggcttctatgctgacgaattctaatttattagggtagactccggcgtcatgtaaagtgttctcaaagagcgtgcgatatgaacagccgtcctctgtcagcagaagggtttcattttgaagatccttcaatgttgctggtgagtctgctggaaaaggatggtcattggcggctaccattttgatttcatcctgaatcagagattcaacgtgcagtgcgtcttccgaccgattcacatccaaaatgaaagtgatatcaagctggccctgcaagagctgttctttcgcttgttcgttggaaatatacggtttgaatataagctttacttgaggaaaagcctgtttgaattcttttatgataggcggaaggcggtatgtgcactggctttccgtcgcgccgattttcaaggttccggttgtttctcttgcttgatttgcggccatttttgcttcttctgttaacgcaatgatcttctccgcataggatttgaacgttttgccggcttctgtcaggaaaagccgcttgcccagccgttcaaataaaggagtcccgatttcttcttccagtgatttgatctgagaggtaacacttgattgtgcatagttaagcatcttggcggttagggtgaagtttacatgttctgctgcggtaataaaggtgatcagctgcttcaattccatttgatctcgccctttctaaatcggttttatcgattgaaacaatcgaaataatcatctgtattgattgatgaatccattatatgatgaagaaaatcattcgtaaacaaaggagcagatgcatcatgaacattgcggttattaatggcggaactcgttctggcggaaatacggatattcttgcggagaaggctgttcaagcattcgatgcggagcacattcatttgcggaaatatcggatccggccaattgaagatctgcgtcacgcccaaggcggctttcgtcctgttcaagatgactacgattctatcattgagctgatattaccgtgcgatattcttgtattcgccaccccaatttattggtttggcatgtcagggacattaaagctgtttattgatcgctggtcacagacgctgagagatccgaggtttcctgattttaaacagcaaatgtcagcgaagcaggcatatgtaacagcagtgggcggagacaaccctaaactaaaagggctgccgctgattcagcaatttgaacatatttttcattttatggggatgtcctttaaaggctatgtgctgggagaaggcaatcgtcccggtgatattcttcatgatcaacaggcgctgtccgctgcgagccgtttattgaaaagaagtgatgcgatatgaagttgctgctggttatctctggtatgttgattcttgcactctttctagcttggaaagcgccgacttctgtttggatacaggctgaaaccaattcgcctcaggttcagcaatttgtgagaatggcaggcgcaacgctgcaagtcaagcaaatcatcaagagtgatgcaggcgatgaatctgttgtcatatcaaacggcattgtggggccaaaataaaaagcacctgtccaggtgcttttctttataaatgaggaatcacaagccctccatacaaaaacgccgcgataatcagaaaggccggatgcatcttgaattttgtcaagacaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggggattggcggaagcgctgaatgatgcgcaagaggacgatcaatgcgagcgccgacggtacgacggtggcgatcagcgcaatcaggaatccgggccatccgcctgcgctgtagccgacatacgccgcgattttggttgcgatcgggcccggcaatgcgttcgcaagtgcgagcatatttgagaattgatcgtttgagagccagctgtatctgttgacgacttcttcaaacatcagcgggatcgacgccggtccgcctccatatccgagtacgtttgcgacaaaaaacgccataaatacataaatcaagatcatgaggccggcattcctttatcttttgaacgtttctttgtgattttgtcctttaatttaaaatgaaacgcgccgtatgccaagaaaatgataatgataaagccgggattgatctgtaacgtttgcaggccgataaaagcgatgataaaaaacaggatgcccgtgacccagccgaaacctttaagcgctttttggccaaactcgtacgccatgatgccgagcatgacggcgatcaccggtgttacggcgccaatcatgccggcaacgattgctgagcggcttaagacattgacagccgcaaacaagcccgccatagcgagacatgtaggcagaatatgtgcgagggttgccgcgattgcgcctaacgtgcctttcagcttaaagcccagatacgcagccatttttgtggcaatcggtccgggaagcgcattagcgatcgctaatatttctccgaattcatcatcatctatccatttgtatttattgacggcttcatggcggatgagcgggatcaccgacgggccgcctccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatatgataaaggcttgtcaccgccggctccttttcaagctttaatgcggtttcctccaaatactgcggctccacctccacgttaaaaaacacggacacatgacggccgattttcgccgggttgatgacagcggtgaatttttcaatcacaccggcatccagtaaatgctgaatgcggtgctgaaccgccactcgcgacaggttaacccgctttcctaagtctgtataggaaatcctcccttcctcgtgcaaaatcgagagaatctgtttatccgtttcatcaaggacaagattcggaatgctgtactcatgttccaaccggcttcaccttccttcatttggtggatattattgtatcatgaaatgttacggtatgaaggggaaatttttttattgttttcgttacgtaataacttaggattatttcttatcggaaagtaaatagtgtgtgagcttttctttcaggaaagtggataccggtgaagccgctttttatacttaggaaaatttgtaaaggggcttgccatgaatacttcaaccatcggaacgaaacaaatggtcgtcagtccgcattatcttgcttctcaggcgggggccggcattctggaaaagggcggaaacgcgtttgacgcggcagtggcggtcagcgcctgcctggcagtcgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggccagaaagcgccattaccgttccgggaatggcggacagctgggatgccgtgctttcggcgtacgggcgtctttcgctcgctgaggtgctgaagcctgctcttgattatgcggcaaacggattcccggtgtccgccgaccagtgcgcccacacagaacacaatctcgctcttttagcctcgacgccttacacctcggccatttttacgagaaacaaaaaagcgcccaggcccggtgaacggtttgtccaaaaggatttggcggacagcttggagcagcttgccgagaaaggcagaagcgctttttatgaaggagacctcgctcaaagcatcacatcctttctgcaaaacaacggcagccgtctgacacttgatgactttaaagcccaccgcggcgagtggacgaacccggtatcctctgattaccgcggataccgcatctatcaggctccgccgaattcacagggctttacaggcttaatgacgctcaatatattggaaaactatgatttttctcagattgaacacggttcctttgactattatcatctgctgatcgaggcgctgaaaaagagttttcagcaccggaatgaagtgctgactgatccggtattttctcatattccgctggatcggctgcttgataaacggtatgcaaagcagctggcggaagaaatcggtgacacggctgcgccggcgctaagccgtccggtcggaagcgacactgcttatgccgccgtcagagatgcggaaggaaatgccgtttcctttatacagagcctttattttgaattcgggtcagccgttacggcaggggagacgggcattctgctgcaaaaccgcgggtcatttttttcgctggatgaatcccatgtcaatacacttgaacccggcaagcggacgttccacaccctcatgccggcgatggcctgtaaagaaggaaagccgcacatcctgtacggaacccagggaggagagggccagccgcaaactcagacagcgatgattacgcgcatcattgattacaaaatggacccgcagcaggcgatcaatgagccgcgctgggtctgggggcggacatggggagaggagtatgaagggctgagggttgaaagcagaatcagccctgaaacgagagaagccctaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagcatgatacgctaactgatgaaaaaaataagcacgccaagagcggcagaaagacctgcgtaaaacgaatcgtacacatattgcttttcctcccgccggtgccgccattccattaagccgctgcagcaaaatagcatgaaaacaactcccgcaaatacgtacatttcattgaacaaagtcaccgctgcgatgcccgtaataagtagtgtgatttcgattaatcgatgtgtgccgtttatcggcttctgctttttaacagcctttggaaaatgaagaactttgacggcaaatacttgaaacataaggctgagcaaaataaatacggctgaaaaaatcagtaactgaatgaaatccatcgtctcctcctaaaaatgtgtcactcgtttcatacgggtgagggccttgtaagtttcagcattctataagacattaggctgagtttaatggtaaaagactcaaaaaagacccctttcgaaaggggtctttttgactagtttcttctattataatggttcctgcttcaggtcgggcggacaagtgtatatgtcttcccgagtctgacgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttgaaacggaagatggcgttcgagtatacattcaaacctgacttttgcttcttttataccgggaacgctgatgcaggcgctgtctgtcacagaaaggtctgtcatgccaagttcactgacatcaggatcaagccttgccgccgttttgttaatgtcttcaataatggactcatcactgacgtgcaccacgaattcccgatgagcgattgcgtttctcgcggtgtctttctgccgtccgtccgcgcggctgacagagatggccagaagcggcggttctgcggagacaacgttatagaaactgaagggcgccgcgtttacggcgccgttgatggatgaccgcgtcgtgacaaatgcgatcggccggggaacgactgtgcccgaaagcaatttgtaggtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacaaatggcgttacttgtagtttttctttacaacccagatgttcccgtctttccagtactctgttttgctgcagtaatcgtcttttttgcaagggtcttttttatgaggacggtaaggttttttctgcgtgcgttttttcttgcggcggcaagattttttgtggctgcgagattttttgtga

SEQ ID NO: 130 - DNA, 44502 bp, Bacillus velezensis FL50S
cggattacttggatcgtccgggtctatacaggcttcagcatcctgtaagtagataatgtcttcaagcttcgtctgcaaaaggagttgtgatttcatgacggtgcgcaggagccgttcagtgcttctattgattgatgataattcccctaaggagggatcgccggaagcgctgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagacatcgatttctccctcttttctcttggtgtcattatgcaaaagtgctatatcgtattcttattccgggagagaagagatcattactgatgttttcgttaataaaatatcccggatatgaaatccgggatattcgttcgtttctttatttcaattcaagtttgacgtctacatttcctcttgttgcttttgaatacggacagaactcgtgagcggcgtgcaccagcttctccgccgtttctttatcaagatcttttgtatcaatgacgagcgttacgccgattttgtaacccccgtcactctcatcttttaaaaggctgacctgtccttcaatttcagaggtcatgtcgattttttgtttttgggcggcgagttcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattgcaataggaaatgggccgtttttcggctacaataggggtaacgttaacaaaaaagagttggtgaaagaatggcagaaaaagattttgaacatatgaaactggagaatcagctttgttttttgctgtacgcaagctcaagggaaatgacgaaacggtacaaaccgctgcttgataagctcaacgtaacttatccccagtatttggcgctgcttttattatgggagcacgaagaactgaatgtgaaacggatgggtgagcttttgcacctggattccggaacgctgacaccgatgctgaaacggatggagcagcacggaatcatcatgagaaagcggtcggctgaagacgagcgatccgtgacgatcaggctcacagatgaaggacgggccttgcagaatacagcggcggatatccccattgccatgctggaacagacgggactgtcaaaagaggaattaaagcaggtaaaacagtcgctttatgaggttttgaaaacgctgcacggcaaaaaataaggatgccccgaatgggcatccttatttttattctgctgccagaagcttcacttcaatatttcccgctgtcgcttttgaatacgggcacacaccgtgcgctttttggataagggcttcaagctcctgtttctcaatgccggatgctttgacctcaagggtaacgccgagtttatatccttggtcgctttcatctttcagcagactgacatgcgcagtgacctctgtttcaatactcagacgctcttttcttgctacgagttgaagagcgctgtcaaagcaggctgaatatcctgcggcaaacagctgttcagggtttgtggcttgttcgagcttttttgctcttggcgttcccggcatggcaacatcaagattcagcaccccgtcagaagacgtgactttcccttcacgtccgcctgcggctgaaacggttgcagtaaataatggttttgtcatataaattcacctctattatattgtgtacaatttaattttacgaaatataatggaaaccgtcaatctttccgcataaaaaaagcttaccctttttgaaggataagcttaaaagattatacccggatttgtccgtttcctttgatgatgatttttgtagatgttaacgccggaagtcccatcggccctctcgcgtgaagcttttgcgtgctgatgccgatctcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgtttttacactgagaatcggcgccaggtactccgctccccaatcggcttcttctgcttgtttcgcttgaggctccagtccgcaaatcacctggtctcctcggagctccacccctttttctgtcagctgattcagcagctttcgtccgtgttcttcggcccatttttcatgaatcagaagagattcaatcgcattgcagaccgaaggacgctgtgttttggcgttgatgacgacctcgcttgccataaggggatctgctgactcatctatgtacacgtggcaattgcccgcaccggtttctaaaacgggtacggttgattccctgaccacaagatcaattaaatttttaccgccgcgcgggatcaatacatccagcccatcatttaatgtaaagagctgtttggcggtttctttgcttgtatcttcgatgagctgaacggcatcaatcggaagctttgacagcccaagtgcgcgtttcatcacactgacaagcgctatgttgctgtggatggcggaagaacttcctctgagcacaaccgcgtttccggttttcagacagagtgtggccgcgtctacggtaacgttcggtctggcctcatagatcatgcccactactccgaggggcacgcggatcttttcaattgataatccattctcttttttaatggtctccaatgattcaccgacgggatcttcaagaccgattagcagttccacggcgtccgcgatatcgagcaggcgtttttcatcaagcgtcagcctgtcaataatgtcagctgtcagtcctctgttccgtcccgcttcaatatctttctgattctctgttaaaataagccggcgttcatttctgagtccggctgcaatacattggagcgcttcatttttttcagccgtcgttttcatgaccatttcggcagccgcttcttttgccaaagctgcttgttgcaatacttcactcatttgtgttccccctcgtcaaataaattcacccaatcatctctgtgaatcacttccacctgcttcgttcctgaaagctggtcgctccgcttccctttggcttctaaaatttcatcggatgagtactgcgtctgccctttgccgataatgccgccgggccctctgacttccactacggctcctttcggaaaactgccgcagacatcggcgacgccggccgggaggagacttgacccgttatggatcatcgcctgctccgctcccccatcaatgatgatttcccctgatatcggagaatgaaacatgatccattgccgtgtattattcactgaggacaggtctttatcgccgatataagtgccgtcgccttttccgtttaaaatcaccatcagtttttcacgtccggagccggttccgataaacaccttcaccccgagcgacaatgcggtctgggcggcgagaagttttgacttcatgcctccggtgccgacctttgagcctgctgacccggcatatccgagcaattcaggtgtgatgtcattcagatagtcaaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagttcttcgactgatgtggaatcattctcattaataatcggcacgacgccgcgctccaacagttccattacagtggcataggcatttctgtaccgctctctttttgagaaatcatttcttgttaataaaatttgtgccggcgtcagaccgtatctttttaaatggtccatatattgctgcattaaaagcgtctggccgactgctgcagctgcctgttttccttttatcgtaacgggtcgcgacggatagccgagagcggaaaaacccgctgccaccgcgcctgaggtaatgaggatcacttcatgcccgttttcttttaataaagaaatggcttccgtatgttccttgatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacacgtcccgctttcctgtaacgccaggtatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagcctgcctccccggcggaccgtcattaattaaatacgatcgttttgtttccgtgaacgatgacacggtcttccagatgccattttacggctcttgccaacacgctccgctcaatcgttctgccgatattcttcagatcctctgcgtgatctctgtgatcgacgcgttcaatatcctgttcaataatcggcccttcgtcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttatactgctccagcagctcaagctggcgccgctcaacttcggcgcggatatctttgttagctttcatgtaatggaatggaatattcagcggctcgaccacttctttcgcctcttcatggttgctgatgacgaccgcaatttcggccatcatattgccgctttgccattcccaaatcagttcatgaaggcagtgcagctctttggatacaaagatcgccactcgcttcagctcacttgccagagagaggctccatgtcatgccgaatgtctgcgcgattgaggcgaacgcctgctgtaaatcctcttttttctcacgaatgcccttgcagtcgaattcgatcctgagaaaaaaacgtccgccttcagggtcagtcgtatattgatttgattcaataatattcgcgccgtgttcaaacaaaaacgcggacacagccgatacaattcccggctgatcggggcagctgacaagcaggcgccctttttcctcattaccgcggcggtattctttcagccgctgtgtcatatatgaattcatctgttttaatccctcgtatcttcataattcgtaacttattatagattatactgaaaatttgataaaaatcaatttacgaaagaattttcagccctacggctgcgcacaaaataagcgcaatgaaaaagatgcgcttcgcatccttctgctcgccgtagaaaagaatgccggctaaagcgccgcccgccgtgccgataccggtccagatcgcataggccgtgcccatcgcaatcgtctccatcgcataagaaagcagggaaaaagaagccgcaaagccgacgattatgaagagaatccacttgactttcttttctttttgaaattgattcattaaaatgaccccgagcatttcacaaagacccgcggctatcagactgatccaatgcattacgccttctcctccttcgtctcaggcttatcctgtgtgaccagctttaatccgatgacaccgatcagcaaaacgccgatcagcacgatttttaccggatcggcctgttctttgaaaagcaggatttcactgagcacggtgcccgctgtcccgagtccggtaaagaccgcatataccgttcctacgggcaggctgtccgtcgccttgattaatagataaaaactgatgatgattcccgtaatcgtgccgccccacgtcagtgccgaatcagcatgtttcaggccggtgacccataccacttcaaatacggccgctatgaccactaaaccccatttcatgttcttcatcctttctgtttccgggcaatacaaaaagcccggaatagtcgtctcacatgagattgactctcccgggcttttttccctccgtgtgcatatgcgggatatgtccgcatatgtgttttctctcggaccaggccatgtatgaacatgcggaaccctagaaaacatgtctgttcgtatcatactacatttcgccgaaacgttcaacgtcagatgtgatgtcaaataccgtcagccgcctctcccatttggtaacggtctcaccgggcaccatgccgattttttccgcgacgcggacggaggcagcattttccggatcaatcagcgccgctatgcgtccgtattgctgcgtatgaaaaccgtagtccagacaggcgttcgccgcctctgtcgcatagccgcagccccagcggcagcgggcaaacatatagccgatttccatcaaagtgtttccgtttaccgtctgcggaacgattccgcattgaccgagaaatgcgcccgtcactttatcctctgcgatccaaagactgacgccgtatcctgcggccaatcgtttgttccaggcaatccattccttcgtttcccgtctgcttttaagagaaggataatatttcatgacctctctgtcggtaaacagcccgtacaaattgtcttcatcgtcatcccgcatagtccgcagacggatacgcccggttgtcaggatggtgccggaagacttatgtttcatcatgcacgccacgtctcctttccctgtaataaattatggacccggcaggaaaagtcctttttcagcataaaaaaaccgcttttaaaaaaagcggtttgacgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggcaccgatttcccgtttgaatcgagcgcgacgaatgtcagaaacgacgttgccgcaagctcgcgttcacccgtcatcagatgttctttaatgactttgacaaacacctccatagacgatgtgccgacccatgtgacgtaggattcaaggcatacggaatcctgttggccgatcgggcgcaaaaaatccacagaatccattgaggccgtgactgtttcacaccggcagtggcgggccgcggaaattgaagcgatatcatcaatatagctcatcagctttccgccaaacagcgtattgtgattattcgtatcaagcggaaaaaccctgcttgtcttgacaacccttgtttctttgcaaaatcttgattctggcaacttcatattatttaaactcccctttggtgtctggtcgttttgacatttcatctgtaccctattaaacaatactttgatcgttttgtctaaaattttaaatattaagttggttagatattctatcagaaatgtttcattatttatcacatccgggaataataaacgcacattgaataccgataggaggatatcacatggacgtatccattcccaaatccacgcggaaaccggcttgccgcagtgagtttgatgctttgcagacagtcatcttatgccggccggaacacatgaccatcaaggatattattaacggaacgcagaaacatttcaaacaagaaaatattaacatacccgttgccctcaaacagcatagtgagtttattgacattttaagatctcatcagattgaagtcgtcctgctgcctgccgatcccgctttgcctgagcaggtattcacccgggatatcggatttgtcttaggcgagacagcgtttatttcaaacatggcggctaaagtccggcagggagaagaaaaagtgtttcaagacctgcttgacgataagaaaatcccttatacgcgactgaaaaaagcgaacattgaaggcggcgacatcttgatcgcagacggcaccgtttacgccgggctgagcaagcgtacggataaagcggctgtccgcgagctgcgggaggcgctgccggagatgactgttgtgccgatccctctcaaggaggatttcttacatttggactgtgtatttaatatgatctcggaaacggaagcgctatactgcaaaaatggcttgcggcagaaagaaattgatcttctcgccgaacgttttgagatgatagaagtgcctgaagaagagcaattcacgctcggcccgaatatcctgtcaatcggcaatcagacaattatcagcctgccacagcaccgtcatacgaaccgcgagctcagaaaaaggggttatacggtcattgaaaccgagttttccgaaattatcaaatcaggcggttccttccgctgctgcaccttgccgcttgtcagaacatcttaaacatttacaaggcagtttccttcaagatacgttaatatagagaagacaagactctaaagggggaaaccgaatggctaagtacataggatacacgggaacatatacaaaaggcggaagcgaaggcatttattgttttgaacttgatacagaagcgaaaagactcagccggccgaagctggcagcaaagctcggcaacccgacatacgtcactccgaattctgataacagcatgctgtattccattgaaaaagcagacggaaaaggcggcgtcgcagcctatcagattcatcagaacagcggggaattaacgtttgtaaaccaccagctgattgaaggcccgtctccatgccacgtcagcattgatgataaacatgaatatgtgttaaccgctaattaccacagcggaaaagtgcacgcctttcccgtcaatgaggacggaagtctgcaggagccggctgccgaagccgctcatacgggaacaggtcctcatgaaagacaagagaaaccgcatacccatttcgctggctatacaccagagcataactacattgcagccgtcgatttagggacggatacgctgtatacgtaccaaatgaaaaacggttcgctcacagaggtgaaaactcactctttcgcaccgggttcagggccgcgccacatcgttttccatccggcggaaaaatacgcctatgtcatgacggaaatcagcaatgaagtcatcgcgcttgaatacaacccgaccttaggtgaattcagagagctgcaggtcatttccgctttgcctgaaggctttacggacaaatcgcaaggcagcgcaatccgcatatctaaagacggcagatttctttatgccgccaaccgcggacatgacagcatcgccatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgtgatccggaaacaggcaaattgactctgcttcaatctgacattccggttccgtatccggtctgcgtgtcatttctgcatcaggtttaatcaaaaagaaagctgactttatattgtcagctttcttttttgtataaatggcaggcgacaaaacgccccgccttcacttcttcaagctcaggcgttatcttaccgcagagctccatcgcttcagggcaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaataggttgacgacctgagcctgtaccgacacatccagcgcggaaatcggctcatccgccacgataaattcgggatgcagagagagcgctctggcaatcccgattctctgcctctgtccgccgctgaattcgtggggataacggctgccgaaatccggatggagcccgacagcttcaagcagttcatccgccatcatcatacgggcttttcttgtattgtaaagattgtggatttccatcggctccataataatttcccttacggtcaggcgcggatttaacgaggcgtaagggtcttggaaaatcatctgcagcttgcggaagaagaccgaccgctgttcggccgcggcacggtgtatatccgtcccttcatatgataccgaaccggccgtcgggtcatacagacggagaataactcttccgagcgtcgatttaccgcatcccgattctccgacaagtccgaatgtttcccctcttttaatgtgaaagctgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagatcgttccttccaaggacagcacttcgattgtttttcccgttttcggggagtgcagcattcgtccgtctcccagcgccaaaccgacatggtgaatcgcgccttttccttcttcataggcgaaaaacaaaaggtcagccggccggatatcgtttaccgccgcgccgcacccggcttttgcttggtcctttgcatcacggggaagggtatagccgtttgctttaaatatcgaatacataaacccggaacagtcaaacccgaaaccgctcagtcctccccataaatacggaagcccgagaaacatcatgcccgtttcgatgacctcggccgcccgtccttccgtatgccggcactcgtctgcgtcagcttcatttacgaaccgttctccgagaggcgtcacaacccgaaaaaagcctttctcacgtcctgatgccggaagacgcgttaagaaacttacttccaagtccggttcgccgttagtgtgatataaaaaagctgtcggtttggtaatccatacggcgggcgaagatgaaaaaaagccgtcttttgaaagctggctttttttcatccagcccggatatccgcgcgcatccttgtttgagggctggccgggaacggcgacaaaagcccattccccttcctctttgagaatgatcacctcttccccgaaaagcgcttgcgtttggacaaggttgtctgtgcataattgcagccgctcttcatatcccatagacgctaaccattttctgatctgcggcgggttttcaagcatcggcgcatcatacgaacggggagatgacggcatcgtccatacgttggctgccgccgctgtaacggctgctctcatcttttcgcctcctcttgtttcgacaccccggtaatgccgagacccggttcatcgggaatcgtaatctgactgccgctgtatgtgatgccgcctttaatcaaatcatctttcagcataagcggcgcatcaaaatcaaaccttgtcacattccgtttgcccgcggcaaaatgagccgcggcggtgatgccgagcttggtctcaatcatgctgccgaccatgcattccacgccgcacgtttcggccatcgcattgattgtttccgcctgctttatgccgcccgctttcatcagcttaatattgattaaatcggcgcttctcgtctgcagcacgcaaaaggcctgacggggagtaaagacgctctcatccgccataatcggcgtgtctacggcatcggtgacctgcttcagcccggcgatatcgtctttatgaacaggctgctcgaccagctcaatgccgaggccggcgtcttccatctttcggatcgcagtcacggcttctttcggcgtccagccttggttggcgtccaatctcagtttgacgtttccgccgacacgtgatctgatcgcctgaatccgggcaacatcgtccgatatgtcacctatgccgacttttatctttaaaatatgaaatcctttgttcacatagcggtctgcatcccccgccatctcctcaggagaattgacgctgacggtaaaatctgtttccagtgtattccgatagcctccgagaagccggtaaagcggctgtccgtgcatttgcgcccatccgtcatatacagccatatccaccgcggcttttgcgctttgatttctttccaacagccggctgatatcatacaaaacagcttctatgccggaaaggctccgccccaagagagcgggcttcagcacatcgcggacggcgctttcaataccgtccgtgctgtcgcctgtaatgacaaccgtcggcggcgcttcgccccagccggtcagaccgttgtcaaatgtgagcttcacaatgaccgattcagcattgtaaaccgtgcgcaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacggcgaagctcggtgaacaatggccgattttaaagcctttgagcgcgggcttccctgatttgacaatgtaatcgttcagcacttgctctaaagtaagcgacttttctttatgcttcggttcgcattggtgaaaatcacagaccaggattccggctgcgtctgacagttttccggccatctttaattgattcagcattctgtcgatttggtacggctcctcatcaatatcctcgataaacagcaatttgtctttcgtatcaatttcaaacggcgtgccgagtgtggacgtaatgagcgacagattgccgcccgcaagctctccctcggcccttccgcctgtcagcacctccagcggagaaatgtcctccgtataggtgaattccgtttctgtaaaaagctgatgatacgacgcttttgtcagaggatcagcatcttcaagcccgacatccgtgctcagcatcgggccgtgaaatgtgacgagccccgtattttgatgaatggcggtatgtaaaaacgtaatatcgctgtatccccagaaaattttcggattgcggcggattaagccgaaatcgatgccggcggcaatgcggcccgtgccgaatcctccgcacgcgcatatcaccgctttgacattctgatcactaaacatatcatggagatcatcgaggcgcgcccggtcttctcccgccaaatagccgtgacgggtcttcagcgcccggccgagtttcacttgaaggccaagctcattctctaaaaacagcagcgcggtttgcagcgtcccgctctcaggcgggcttgcgggcgcaatcacaccgaccgtgtcgcctttttgcagtgctttcggtttatggttcatgactttttcaatctcctttccggattgaaaagtgaaacacgccgctcctttaacggcaaaagagcggcatatgtttccgctgtaagatcaggacttttccgcccatttcagatcaatgtaaccgacggggtgccggacaatgcccttcacgccgctgttctgcagatgcacctgattgtaaaagtaaatcggaatgatcggagcctcgttcatgagcagcttttccgctttatgcatgagcgcaaaacgttttttggcatcggcttcctgttttgcctgcttgatgcagccgtcgtatgccgcgcttccccagccggtgcggttcatggaattatccgtttggaaagcctcaagaaaactgatcggatctgcgtaatccggtaaaaatgagctttgagagaactggaacttcagtcctttctgctcttctaaaaagacgttccattccatattggcgagcttaacgtctataccgagcacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggagttagtaaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggctccattttaacgttaaaacgatagaaatagagtccggcctgatcccacgtgcggacattttttcctcccatcagctgctcgctcagctctgccggcacaaaggcggtatccaaatcccccgactggaacatctgatagtcggtatttcggtcactgaccatcgcccatgtcactttatccagtttcaccgtctttttatcccaatacgtctcgtttttgaccatcgtcatgctgtcgtcatgcttccattccgtcagtttgaacggcccgttgccgacaaaagtttttgcttcagtgaaccatttcggatcagccttggcgaccttctcattaatcgggaaatacgccggattggacacgacgctcaaaaaataatcctgcggggccgccaatgtgacgacaagcgtttttttatcctttgccgtgactttcacgtcttcttttttgccttttccgctgttaaattcttctccgcctttgatcatatagccgagaaaagcggaagatgcgcccgttttcggatcgagcatccgcttccaggcgtacacgaagtcttccgccgtgacgggatcgccatttgtccattcggcgttatctcggatattgaaggtatatgtcagcttatcagcggacaccttccagctttccgccatggccggttcgggcttattatcttttccgagcctcgtcaatccttccatgatgttattcagcggctgccaggaaacattattaaatccgatcggcggatcaagtgaggtcggctcattttcgttattgagccgcagcaccgtctctcccccctgttcttttgctttgccgggttctgtccccgcctgttcattggctgtacagcccatcagagcaaacgaaacaacagcaatcacaccaatcgcccatctctttttcatttcaatccccctttttcctctgctgcagtcagctgctgcttcagccgctctgcacggtgatcctgaagccagcagctgacgatatggcttttggatttcacggttgttgccgggtataccttttcacagacgatcatcctgtccgggcagcgggcggcaaacgggcagcccggcggcggatcaaataaatcaggcggcgtcccgtcaatcggcgaaagctcactatcttccatatccagccgcggcactgaacgaagcagcccctttgtgtatggatgagccggacggtaaaaaatatcatgcctcgtgccgatttcggcgattttccccgcatacataacggcgactctgtcggcggtctgagcgacgacgccgagatcatgggtgatcagaataatagacacgcctgtttttctttgaatcttcttaaataattcaaggatttgtgcttgaattgtcacatcaagagccgttgtcggttcatcggcgatcataatttccggctcgcagatcagagccatcgcgatcacgatccgctgccgcatgcccccgcttaattggtgggggtactgcttcaggcgggatttcgagtccgggataccgaccagatccagcatggcgagaacctcggattcagcttgttttcttgtcatggcgcggtgttccaacagcgcttctgagagctgatcccctatggtcaaagtcggattgagcgccgtcatcgggtcctgaaagatcatagaaatatcgcgcccccggattccccgcatttcccgatccgacattcggcaaaggtctttctgtttaaattgtatgcttccggattcaatctttgccgaatgtttcggaagaagacccatcacggcttgtgacgtcacgctttttccgcatcccgattcaccgacgatcgcaaacgtttcacctttatataaatcgaagctgacgcctctgacggcttttacagtgcctccgtatgttgaaaaagtaacatgcagattttgaacggaaagaacttgctgcgccatttttcctacctcctcagtttcgggtctaacgcgtcctgcaagccgtctccaagcacgttaaacgcgtacatcgttaaggaaatgaaaaaagcgggaaaaaacagccgccaccaatggcctgataaaatcgccggcagcccgtcgtttgccatgactccccagcttgcaaacggcgcctgaatgccgagtccgagaaaacttaaaaatgattccgcaaaaatcgccgccggcaccgtcagcgtcatttggacaataatggctcccatcgtattcggcagcagatttttcttaatgatccgaaatgttttcgctccaaatgttttcgatgccaatacgtgttcatcatgcttcatcctcagcacctgccctctcacaatccgcgccatgccgacccatcccgtcactgtcagagcgacgataatggaactgagccccggccccatcagcaccattaacaaaatgacaacgagcagataaggcaaaccgtagagaacctcgatgattctcatcatggcgctgtctgtccggccccctttgtagccggcgacgcctccgtagataacgccgatcaaaaagtcgatcagcgccgccatcacaccgacaaataaagagatcctcgctccgtaccacgttcttgtaaacacgtcccggccaagttcatcggttccgaaccagtgtgaaaaagacggcggaagattctgctcggcgagcgtctgccttgtcacgctgtgcggtgatatcagcgggccgaacacagccgctagaaacaggcagcataatatcacaagtccggccatcgccaatttgttctttttaagccgccgccacgcatcctgactgtaagacaggctcggacgcttgaccgactcggtttcaccctttctttccgcgcccggctgaaaccagtcatcaggcacttctgtgtgttttaccgtttcttgcgggagattcatcaggatcaccctttcttatgaagttttatgcgcgggtctaacaggccgtatgccaaatcaaccagaaacagcaggacgatcagaatcacactgtaaaatacggtcgttcccatgatgaccgggtaatcgcgctgattgatgctttctacgaaatatttgcccattcccggtatggcaaaaattttctcgatgacgaaactgcccgttaaaatacttgcggcaagcgtcccgagtactgtcacaacaggcataagtgcgtttttcaatgcgtgtttgatcacaattttgacgggagaaagcccctttgcttttgccgtgcggatgtaatcctgagtcagcacttcggccatgcttgatcttgtcagccgcgcgataatggccatgggaccgacggcaagcgcaacagtcggcagaaccatgtgaacgggactcgtccaggtagctgccggaaaccatttcagatgaaccgcaaattgctgaatcagcagcgtagccattataaaattcggaatggaaatcccgagcaccgcaaggctcatggccgcataatcgagaaagccgccgcgcctgagagcggccgttacgccgagcgcgagtccggaaatcacagcgatgatgatcgccgttatcccaagctcgaaggagacgggaaatccgcgttcaagcatggcgtttacactgtctgacggttttttgattgaaggaccgaaatcaaaggtaagaatggattttagatagatggcgtattgagtgataagaggttcgttcagatggtagtaggattcgagatttcgctggaccgcttcgtttgtgccccgctcttcgttaaaaggcgagccgggtatcactttcatcatgacaaatgtcagagtggtgatgacgaggacggtcataatcatggcgataaaacgtttgataaaataccgcagcaatgccgttcacccctttaacagaatgttgttctcatagcgagttctgtcatgacgagcatggcctgataggcttccggcatgtcttttgcctgaaattgaacgattgtcgttcccgggatgatttctgtgcccggcattaaatgggcccattcagcctgtccgtaattggcaaattcaatgcctaatacaggtctttcaggcggagtcagcggtttgaccttatctttatttttgagcgcataggctgttttttccgtcaggagccgtccggctttttgaggggacaggcatttgaccgcagttcttgaaatggtttgtttgacggcggcagtcgtcacattcgggatcagctcctccgcctcttttgcggcgcaatcatctccggcagccatgatgaccgggacatcgtaaaatccggcgagataggcatttaaccccagttcaccgacaggcttatcatttatgtaaaagtggcggacgccgaatatcatgctgtgcgacatgacgcccggcatcgacgctctcgcatgatagccgataaacatcacacctgaatacgattcatcaagcccctgcatcatggaaaacggcttgacatcccccgtaatcagctctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgctggaattgacaaatgtttcatcaggcagtccggaaatcccttccatatccacagatagatacagtttcatgtaatgcctccttttttatttaaaatttcgatattaaattatgaatattctaacaaattatattaaaaaaggatgaaacatgcaatataccattctgccattatgggaaaaaacaaacccttttcaccgggaaaagggtttgctgatagaaaaagttacataccgtttttgtttatagggtgaccccgaaactgtctgaccgcacttctgtattcgcgatcgggaatgacctgatgcctgatcggtccaggagcctgcggcgaaggctcttcatccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggcgattgtgtgccgcgcgcgccccgaagcatgccggaagcatctcttttcgtaaaataccctattaaaacaggtgcgcccatataaatgaacagccttaaaaactgaacggccgtcatgcgtttcaccagttccggaagcggtccgcccaacgcggcgcccatcagtccggctgctacgataagccctgtcccggccgccagcatcacgaaaagcgccgcaaatagaataaacggtatatgatgacccgccgtcatccattggaaattcacgaacaccagtatgacagagcctgttatgccgagcatgcccggaccgactttatcatatgctaatgcactgagaacagcggcgatggccacgcctcccaaaaggctcgcatataagaatatcagttgagtttgtgacatgtgatatgcggtctgaagctccccgtgaaatgcagaaagactgaccgctatggaaatactgcccgcagcgatcatgaaaacacccagaatcggctttggaatcagcataagtttaatcgaaatcagcgcatgttcgtttctgtactgcataatcagcaggatcagcagaatgacgatgcttcctccaaatcccgccaatgtctgccatgatgaaaagccccatttcggcagatgaataaaagtataggcggtcagcacggctgatccacccgctaacagaaaaccgatgccgtcaaatggagatttttcagtatttttatgagcgtcatcccgcagccacatataactgaaaatgaggccgaaaaaagacagcaggccaaaaatgccgaacagccaatgccaatggccggcgcttgccgccgccgtgcctaaaacggtccccataatgacggacccgtaaaatccgccgattaacacaaataaggcgtaattccggcgttcaatcggaaacgaaagcaccagcatcggaatcataatcatcagcatagtgcccgccgcagctccctgtaaaaaacggcccgcggcgagcggataaatatcatttgtcacagcagcaagcagcgctccgatgacacccgcggccatcgaaatcatatagacaggccgggagccgaatctttttcttaaatacggccccgccggcacgaataaggcaaatgccatattaccgataataatcggatgaaaagagtcaaagttttccccgccgaccgtctgccggacaaggctttgggcagccgaaagagcggtattcgacatcagccccggcccgacagccagcacagcaagcagagaaatgatccagtgatgtttttctttcatttgacagctcctttcttactatttgacaaagtgaaaaagctaacagatttcccccattagcttgacagaatttttcatatcttttcatgtgaaggattgaacataatatctcattattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagccggccggatattccgagccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttctgattccggcagcggcaaatcggcaaacagctcatcggcaaattcaagcagcatttcgaatatggtggaagacatttcaccggcgatcgtcggaatcaccaatctgcagaagcagcaaagcagttccgatttattcggattcggatcaagctcggattcaaactctaatgcatcgggtgatgatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggccgtgattcgctgacggacttggccgtattagaaatcagtgataaacacgtaacaaaaacggcaagcttcggcagctcatccgctctcagaacgggtgaatccgtcatcgccatcggtgatccgctcggaaaagacctttcccgcaccgtcacacagggcatcgtgagcggcttaaacagaaccgtctcgatctctacgtcagccggtgagtcaagcatcaacgtcatccaaaccgatgccgccatcaatcccggaaacagcggcggaccgctcttgaatacagacggcaaaatcatcggcatcaacagcatgaaaatcagtgaaaatgatgtagaaggcatcggctttgcgattccgagcaacgatgtaaaaccgattgccgaagagcttctcacgaaaggacaggtggagcgcccttatatcggcgtgagcatgatcgacttggaacaagtgccgcaaaactatcaggaaggcacactcggcctcttcggcaaacagctgaataaaggcgtttatattcgcgaagtggcgcagggatcacctgcagccaaagccggattaaaagcagaagacatcattatcagcttaaaagggaaagaaactgacacgggcagcgaacttcgcaatattctctacaaaaatacgaaagtcggcagcaccgttgacgtgaagattatcagaaacggcaaggaaatgacgaaaaaaatgaaactgactcaaaaagaagaaacatcttcttaacaaaaatccaaggcagccgccttggatttttatatacagatgaaactttaggcctggatcagccgtatgactcagtgtacaaaggaggatacatacacatgaaacaaaccggacttttgctggtcgttaccggcctgatcttgctgcagctgagcattcagcttcctcagcaaaacgctgcttggggaatgacgcttggtgcaagcattttactggaatttttcgggaaccggactgatcatgcgctctctgcacacccagaccggccgcagatgaataaaaaaagccgcgggacattctgtcatcccgcggcttttattttacataaaagcaccctgtccgctggccggacagggtgtttgttaagacatatgctggtcccgataaatcttttcgtttttcatgccgtacgctttttgcacgatatagagcggacgatcttttgcttcgtcataaatccttccgatatattcgccgatcattccgagcattaataaaacgatgccgctgaataacagctgtatcacaatcagagaggaccagcccgtaatggtgctgtctgtaaaaagcttcatgtataaaacgataaacatatagagaaaacccgctccggacatgagcattcccgcatagcttgccgccttgagcggtttatgagagaacgttgtgatcccgtccatggaaagcttcagcatttttttaagcgggtatttcgtttcccccgcaagccgctcatctcgttcatattctacagcagtctgcttaaagccgacccagctgacgagtcctctgacaaaaggatttttttcttttaatcttttcatctcatcacagacttttctgtccagcaggcggaaatccccggtgtcgagcggaatatcaatatcagtcacgctccgcagcagccggtaaaacagagaagccgtctgtttcttgaaaaaggtttctccctttcgtttcgttctgacggcgtacaccacatcgtagccttctttccactgctcaatcatatcaaggattaattcaggagggtcctgcaaatcggcgtcaatgacggcgattgcattcccctctgcataatccatgcccgctgtgatcgcgatctgatgtccgaagtttctggaaaaatcaataattttcactctcggatcaatcagactttgctctcttaaaatctcaatactgcggtctttgctcccatcattgacaaagatcaattcataatgctcttttgtttgatccatgacttctttcaggcgctgataggttgtctgaatgacgagttcctcgttataaaccgggacgactattgaatattgaatatgtctgctcatgttttttcctcctattcatcagattgaagttcgtatagtgaagctgactgattcattccgcccggcccgccgctcattcggctgtttttacccgcggccttgctgctttttgtatcagctgcatcatgatttttcgttttctgatctgtgcttgattgccatttgtctgaagatactttctttccgtttttctcaacccattcaacaatatcgttgtttccgcctttgcccattccggatgttaagaagtattttactttcccttcttttacgagctttttaaattgagtcagcgtaatggccgggtcagacccgctgaatccgccgatcgccatgaccgcttttttcgtttttataatgtaaggcgccgctgtgttggaatcggttgcagcaaatagataatccgctccggcgttatgtttctctaaatagttgatcagttttgtattgacagatgcgttatccattcccatgccttttccgcctgctgacgcaagctgagggcctgtttcaggcaatgagctgttgcctccgtacagaagcggtgtgctcgcccaataaatcggcatcaccatcaagacgagaagggctgcaagtgaaacatagtaactgagcggtttttggcgctgtttgaatacgaacagggcgattgccgccactgcgccgagaacgcctgctccgatgctccagcctgcgccgatttgatcattgtagtttctaaggataaacagctcaaatccggttgtcacaagaatagcggccggcaatagccaagttttccatcccgcctgcttgcggtacagatgaacgagggcgacccatcccgcaccggtaagagcagcaatcggaggcgccagcataatgagataataatggtggaaaaattccgccacactgaagaatccggcaatcggcacaagccacgctgcccaaaagatcgtttccttctgttctgctgataatcttcttctttctctcgctccggcgatcaataaaccggccagtccaaaaatcgcaaacggcaggagccagctgatctgatcagataattcttgttggaagagtctcagcggaccgggtgttcccgtaccgaacattcctgaccctgactgcattttcgagccggtgcctgtaccgctttttcctccgccaggaccgcctttgccgccgtctccgccgcttggagggcctccttgaccgccgcttggcatttgtccgttagatggaggtgccgtcatactgccggtttgtgttttgtctccgcttgctgactggccgggcggtttttgcatttgtgaagaaccgccggaagaagacatctctttcgatgcgtttccgtcgggcccgccctggccgccgccggaactttgccccgtcagccgctgaatcccgttatatccgaaagccaattccaatacggagtttgtctggctgcttccgacatatggccttttgccggcaggaatattgtcaacaatgagcggccatgacaatgaaacggctgctaatacggccagcgcgcttaccagtgaaatgatttttttcttaatcgcggtatttgccgccatcatatagaacagcaagaaggccggtaagatcatataagcctgaagcatttttgtgttaaagcctactccgacgacaaaaaatgccgccaaaagccagatcagttttccttttcgaatcgctttaaagagaagccatgtggcgaacaagaggaaaaagaccagtaaagcatcgacattgtttgtgcgcgctacggctacagcaatcggtgtacacgccatgacaaacgaagcgatgcgcgccgccgtttttccgaacgtcggctttattaataagtacatgaatagaactgaacctacccccgccaatgcctgaggcaggatgacactccacccgtgcataccgaatatcagcgcgctgatcgtttgaatctggtatgtaacaggcggtttatctaccgtgataaatccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaataaggattaagactgcgtctatctcgcgttttttcattttcacctgtgttttcactccttttgtttaactttgaacaagtgtaacaaccaaatgtgaaaaatttattaataaacaaagacatttattttgccgtttacaaataggtaaaaagaatgacaaaacgggtaaaaaagcaaaaaaaaagatgcccccgtcaagccggaaggcatctttcattacttctgatttactgaatcggtttcagccgcgcttctatttcagaacggcggtgttcgagataaggcgggagcgcaaccgttttgcctagctcttcaggtttttcatcaaccataaatcccggaccgtccgttgacaattcaaacagaattccgttcggttcccggaagtacagcgctttgaaataataacgctctacaatgcctgagttgctgaaaccttctttcgtaatgatgcggtgccataaagcaagctcctcctcattctgaacacggaaggccacatggtgcacgctgccttttccaggacgctcgcgcggaagatcgtttctttcaatgagatggacttctgtacgcgcgccaccgtttccggattcgagcaccgtaaccgcgccccggtcttcatgtgtttctttcccgatttcagtgaagcccagcacatcggttaacacacgcagcgtcaattctgcatacgggacggtcaattcaacgggaccaagaccgcggaaagaatattcttccggtacgccgctttgcttcaccgcttcaccgatgtcttttcctttttcgtcagctgtcagcacaagccgctgtccttcatgatcctgaaaagcgagtgtgtccctgcccgctattttcacgatctcaccgtgagagacctgatgctcttcaaatcgttttttccaatattgaagcgcttgtgcatccggaacacgcaggccgattgaagaaatactgtttgtccccgcatggaacggcgcgatccgcggaatctcgaaaaacgtcaattccgatcccggattggctgattcatcaccgtaaaataagtgatacatcgtcggttcatcctggtttaccgattttttcacaagcttcagccccaggatatttcgataaaaatctaaatttttctgcgcatcagccgtcaatgctgatacatggtgtattccattaactttcaatatgttatcctccagtcaattatctcgatttcgagatattttatatatacaatttatgttatccggatcgtaaagtcaacccatctgcttcacagacggtctgcagactgccgctctcaaaataacgaacttttgatattaaaaaaaccattaatgttcgcttttaaaacagtattttttccttctcaaaagcataaacctttatcttttaggcaaaacaccaaaatcagaaaatttattttattcgtgtttcagcaattagggtttacaatatggaaaatagttttttcagcataacgattttacatctggagggaaaggatatgcagattgaagagaacggacttaaaaaagagatcggccttaccatcgccctctcacttgttatcggcaccatcatcggttccggcgtatttatgaaaccaggcgccgtgcttgcctactccggtgatgcgaaaaccgcgcttatcgcgtggctgttaggaggcattttgacgcttgccggcggcttgaccgttgcggaaatcggcactcagattccgaaaacgggcggactttatacatatctggaagaagtgtacggcgaattttggggctttttgtgcggatgggttcaaattatcatttacggccccgccattatcggagcaatcggcttgtatttcggctctttgatggcgcacttgttcaattgggattccggctggtctaaattaatcgggatttcagccgttttgtttttaagcatcattaacattatcggaacgaaatatggcggcatcgtacagggaattacgactgtcggcaaattgattccgattatctgcatgatcgtgttcggcctttggaaaggcgatcagcatattttcacagccgtcacaagcagcatgtcggaaatgaatttcggcgccgccatactggccaccttgtttgcttatgacggatggattctgcttgcggcactcggcggcgaaatgaaaaatccggaaaagctgctcccgagagcgatgacgggcggactcttggtcgtcaccgccatttatcttttcattaactttgcgctgctgcacattcttcctgcgagcgacatcgtcaaactcggtgaaaatgcgaccggcaccgctgccggaatgctgtttggcgacatcgggggaaaattgatcagcgtcggaatcatcgtcagcatcttcggctgtttaaacggaaagattctcgcttttccgcgtgtctcgtttgcgatggcggaacggaaacagctgccgtttgccggacagatttcgcgggtgcatccgacattccgcaccccgtggattgccgtgtcatttcagatcgcgctggccattattttcatgatcgccagcaatcccgataagctgtctgagatctctattttcatgatttatattttttacgtcatggcttttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgcgctgtccctcttgatcggcctcgccgggctgccgctttatttttggctgaaaaacggcagaaaaaactgacaaaaacggttccttttacgggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttcagatgagcatatcgataagttcagcggatacatcagagagtgcgcgaaggaaattttaatcacgattgagctgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgagatttacgaaacgcttgaggaaattgccgactcttgccaaagcgttgccaataaccttgaaaccattattatgaaaaacgcgtaacgaggggttataatggatactctattacttttaacgatattaattgtcatatgcgctttggtatttgacttcattaacggatttcacgataccgcaaacgcaatcgccacctcagtttcgacaaaagcgctgaagccgcggcacgcaatcgtcatggccgccatcatgaactttctcggagcgatgacatttaccggtgtggcgaaaaccattacgaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcggccattgcagcgtcaggttttgcgacgcttaattataaagggttcattaagattatcgaagcacttattttatcgccgattatcgcctttgttctcggctttatcgtatattcgatcgtgaagctgatttttaaagacagcaatctggcgaaaacaaataaacgcttccgcagagtgcagattttgacggctgccattcaatcctatacacacggaacaaacgacgcgcaaaaagcgatgggtatcattacgatggcgcttatgacggccaatttacataaaagtgatgccattcctttttgggtgcagctctcttgcgccctggcaatgggtctcggcacatccatcggcggctggaaaatcattaaaaccgtcggcggaaaaattatgaaaatccgtccggtaaacggcgtatctgccgacttaaccggcgcagccattattttcggagccacgtttattcatctccctgtcagcacgacgcacgtcatttcgtcttccattctcggtgtgggcgcttcccaccgcgtaaaaggcgtaaactggggaacggctaaacggatgcttattacatgggtcatcaccctgccgattgcaggtacactcggcgccatcgcctttttcatcttagatctctttttctgatgacatccgcttctttacagaagcggttttttttgtgacaggaaaatgatgtcatgacatagaatgaacatagcagaccatttttcgaattgtgagggatgctcatgcttttgttttttcagatcatggtgtggacgatggcggccgcactcattttatatgtgtacgcatcctggcggtatgaagcaaaggtaaaagaaaaaatgtttgccatccgtaaaacgtggtatttactatttgtagtaggcgccatggtctattggacatatgatcccgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatggagaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccaggaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgacaagtataaacaaaaaaaagcttgattacactaaggacaggagacacggctcttgtccttattccttttttccatatctttcatataataaaaccaacaaagagatgcgacaggtgatgatgtgaagaaaattgtcagacgcgtaaagtttgtggattacggacgcttcgggctttccgcttattcgctgaggatgcgggcgaggaatctcgggttattgaaccggttaaaaaagaaaaaaggctgaatcccgcaatgtgaacgggactcagcctttttttgttaaagctgcatcagaattttcgcttttacagcgggaccgtagacgccgtcagacgtcagtccgtttacagattggaagcgggccacggcatctgccgttttcggaccgtagataccgtcaatgccgttattgacagctcctttttcaggatagaaataaagcgcggcgagcgcgttctgcacctggtataccttttcaccggacgtgtacggctctgtcagcttgatcacctcatccggaagagaatacagtgcttcaaccggcgggctgacgatcagcacttgtccgactttaatcaagttcgggtcagcgatgttattccatttctgcaggtcggccacgctgacgccgaatttccgcgcgatcgccgacagcgtatctcctttttggacggtatacgtctgtctttcctcagaaccgattcccgctttaaactcatcccatgtatccagcagtcttctcggacaaagctttcctgaccaatgcttgtgcgcaacgacattcgcaagcgggatgccgtgcgacgtcattaatgtgcggatgagccattgggcgtttgccacggcctgtgaaaagttgccgtcagcgttttcacaaatttcaataccgatggatttacggttgccgtccccgtttccgtcaccggcatgccagccgttttcgttcagcggaagatgctgataaatttccgtatcatcgactgtgaaatgccagcttgtcggtgtatcgggatttttcacatagcttgcgtgacttttggcgttagccccgactgcggtattggctgtattgtgcaccgtaatgtaaatcggagtcattgcatagcctgggcggttattgtttcctgccgggataaaatcctgtgtgatttttaccatattctcatctctcctatttcgataaattgtttatttttaataaagcctgctgttttttcccttttgctgtaacataattgtttttaaaccaggcagcggcagtcgttatgattgtaaaaacggccgaccctgcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcgaatttcatatcggtttcccccttacttttgcagcagattgtacatgatggcgatggctccgccaatgacgcccgtgcagattgctgtcacgatcgctcctgtaatggtccgcttaatccatgttgtgttttcgtcaattttgttcagtttttcattcagcgtcatgatttgctgatcctgccggtctgatacccgctctaatgcggctacccgctgttcaagcaccttttgttcacctttgatgcctgcgaattctttttgcaccgcttgttcatccagaagcacttccgctccctcctcttacattgttctcacctcccttcggaagcttcattcttaagaaaatgccgtgcctttgacagaaaggctcccgccggaaatgctcttgatttccatgacgatttccttaaagccggcaatatcaaatgcccacacttcttctgtgcctgacgtaccggcggctgatgtcccgtcatcagacctgattcctctgatcggcacattttttcccgagatggatctcccccaaaacgcgacatggcccgactcagccgtgccggtgatttcgacgagaagttttttccaagcgcctgctgagaagatgcttccctcgcccgcctctgctgcattttcatgaaaaatcacgtctgtatatgaaaatgccatatcaccgcccgtaccgacagattggtataaaacaaattcggactgcttttgatttccattttcaaaacggaaccggtaatatctttttgtcaggctgacccaccccgaagcggtcagcactccgccttttactgcgacagaatgtgaagctgtccacgaattgttatcctcgctctcttcgataaaaagagttccgctgcggtccgaataagcccacccctgtgctctgtttattaagacggctcctaaacggtcttgtccgaattggctgtagacttcaatcgcttctagcggcgtattggtaagaagctctgccattccggacaaatcagcaaccggtgtgacataatcgtttttgttaccgcgataagcttttacggcgccgggcctgccaagttgatcggcgggaaattcaaatgaatgctttttcatcggccgtcctccttttctcatttattaaaaatgacaaataaaaaaagccgtttggcttatgacacagcatttttatagttttcgtatgtttcacccgttatttcttgaaattcctcgggcgtgatatacttcgcggccacaccttcagccagatcttcggcagagcagtcatcatagcccatagcctgttttaccatttctgttgaggcccactcataaaacaaggcgtaaacccaaaagttaagttttttcatttttttcattctccttttacgtttaagagttccagttttaacgacgctaattgcctgccgagtgactgctgcgcttgttcggctgcttttctggccaatttctcattcgccagctgtccgccgaggcctgcaagctggtttgaatcgggagccgtatctttttttaagctctctttatatgcttcgtcagcggtttccacccattcttgtttcccttcatcaaaaaatgggcgccacatgccttcgccgtttatttccggcggaaagcccgcagcgttaggcggcatcatataatctcctgtctcagaatccggataaagctcaaccggagtgcctgtataaatgttgtcattgtcatacggaaatattaatttcatattctcgctcctttacgtgagtgccaaaacaaggtcaatataatagccgttcacgttattttctatattggccataattcccgtcagcttcatatctccattagaatagataataaatttgctgtaaccggtggtgccgctggctgcaaccatcgtcacaacgcctttggccggcgcacaagaggacggcacactcccgaataccacttctctgtccgtaagaacgtgtccgttcaggtgaagggtgtttcccactttacggtattgaagcggcctgtctcctgatttagcgccatttttataaggaacatttatccaaggtacattctcagtatcaagttcagtaacgaggcgacgccagccctgccagcccaagttcaaatccaaatagttcgtgaacatattatttttataatcgacggcaatgacatacccaaacgttcctttcccctcactgtcaagagaggtaaaatgaaacatgccgcgggttgaagcgttgctcggactgtttgccgctttgccggttgaataaaaggtgccgaacgccctgccgtttttaacgattttttcaagaaagttatcatcatcaccaattgtcagaagatagccgccgttatcgtttgttattttcgaaagctgtgcgccgttccacatatctttatccgcctgtgtgacatgaatgtcttttttattggcgtgagcctctacttttgcttgagagcctgaatctgtttcttgttggctccattccgaccatacgcctttagtgctgaaacttcggacgtatatgggatttccggcggtcactgtgtctataaacatttggacaaaagtcggtgatgctccgcgggttctttgcatgacaattaattgtccgtattccgcaggcttattttccgtatgctgaactgatatatagtagatgccggacgtttttatattgtctaagtttgtttctgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcagccattccgtccagatgccgtttttcagcgtttttctccaaaatcccccgtcatctgagaaagcggccgcctctccgttattctttgaagaataaaggtatataccctctgacggtttaggcggggtatttattccggttgcagctgctgagaaagtaaaggtcttattctggctggcagcggtctgatgaaaatcctgtccgtcagagatattaataaaagcggagccatcatcttttgtgattttagacaattgcccgttattccacttctggcgctcttctttcgtcacatgccggtccagatcttgattgtgccggtcaaaatctttctttgctgcctgctggacattgtccacgtttccgaggccgatttgcgcctttgtcgttttgtgcgggttgttcatgtcgtttttatgggccgccagatccgtgtgggcgtcttttatgcctttttcccagcggttgacgtcatcttcattaatcggatcgtccggaagccagtctgttttttcttcgtaagccatcgttacaccacctcaaaggtaaatcttaaatcaagcgttctgttattgctgagatctaaatttgtttttcgttctgtaatgacgcttcctgtttcgtcaagcatctgcacggtttcaatgtgtttgacgtcttcttccctgcgtgtgagaacggtgactgcggcatcttttacggaaatgtccgcaatcggagtttctttgccatttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacataagctgacggatgttttaaaaaacggtttagcgcctgctcgatcgcttgatgtgtgatgggcggaatattcgacatcttcgagatcagcctgagccgtctcatatcctccgtgtcacctgattcccgcggtatttttaatattttttcccagcggtcaagcccccatgtcgccgtcgtgataaagagctgatccgtcaaatcgaaaatatcgttattctgccgctcaaactcaggagcttccgccataagcagttgtgccatctcttttaatcgggttaaaaacggcgggaggtacgccgtcatctcatcgagtctgctcaaggattttcacctctttgagtttaggaatttccacgtcactgagcacgaggttttccgccgcaccgttcattttaatatcggcgtagtcactgacggatgccgagttataaacgatgttgttaatttgtgataaacggacggtgttttcttcaaaggccattttcttgaataaattcagtacgcctttttcaatctccgcttttacgtcatcgatcgagctgttcagctcaggcagcacggaagcggagatttcgatttccttccatactgcgctttccaccgttactgccgctccgatcggcgcctgtccttctccctgcccttcgtccggatcaatataatcctttacttttttgatcagaatatctgatgccggttccaaattcgcatttgtgatgacaactttcactgttccgtctccgttccaaagcgggaagatttttgccctgccgacgccgtcaacctcttcggcccattgtttataatgctgtttatttgcgctgactgcctcccggcggacacgggtaaaatagcgcgcccttaagctgttgtcatcttcttcctcacggccgggaattaatatatcgcgcatgactgctttctcaagcccgggtatcgtatcaagcggcagcaggttctgccccgaaatgccggcattgcccgcttcaccggctgtttcacattcaagcgttccatcccccgtatattgaaaatacaggttatcaacgaagaaacgggagcctggcggaatggtgatgcccgctgtgaattctccggctctgaccgctttagtggcaggggttcgttcaattcccgcctcagcagcacgcctgtccagaaattcgccctgagccgtatcggaaaacacgagctccagaacggtatcaagccaaatataagactttgcaagctcagcggccgcaggcgcgagcgcattgtaaatgacgctgccttctctcgtatcaatatccgccgtaacgcgcgccagcattctgtccataatgtcgtcaaacgtctgagcttcaaacatcctcacccagcacctcctctatctcaagcatgccctcatcagtttcaacggtaaaagagacgatgaaggcatcatcttttttctcaatctcaaaattggtaacggccaaaatacggtcatcatacagcaaggcttcttctatcagtcttggaatctccatttttttataagcatccgtcgtgttctgatctgaaagcacttcctgaagttcgtttccgatatcatggctgaaaaccgaatatgaataccgttctgtgtgaagagcgatatagacgaattgtctgattgcgtccagtccgtttatcagttcattggtaatccgattgttttcaaagtcaattcggtaggtttgtgaagtctcaacggcctcactcgcatcctccaaatcttcaaattcgatttccggtgtcagggccattgcacccgctccttttagatttgttcatgtaaaaaagccctcttcggcagatgaagcggctttaataggctgatattcccgtatatctccgtccggatgccggttaaattttgtccagtacaaagaaagactgtcctcctgttaaagcggcggtcatcacccgatctcccgcctggagctgatcatcttctccggatctcagccgcttcggcacaatgagtgcatcagacggaatcaaaagtttgtcgtgatctttcagtttcagctcgagcggcgaaacggaggtcacttcggccggcatcagctccaccggcgcttcagcgtcaaccgctccgacagctaaatgtttaatggcatcacttaatctcatcaggctgtcccctccggaagtgaatttttctccgtgacgtcaatcgtcatggtatgttttgttccttggaattcatggcggtccgtatctacataataggttttcttcagcccgatttccggaattgaaatatagacgggcaatccgctttccaacccaggaataccgatcgcctgtatatttttcagctctttcttaatgccttttttctcagcctgcttcacttttgcgcgctgtttcagctgggcttcgttaatgtcgtcagaaaccgtttcggtatactgcaaaacgccgaatgttttcatgccggcgctgtctgaggcggaagcctttatcgttttatggtctttttgcagccgcatgacgacacgggttgcggtgtcatcaattgaggtgctgtattgataccctgtaatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatggtatggcctgtgttggcaatggatgtgacgggaatttgaaaatcgctggcgatcctttttaatatttgatcagcgcgcttgttggaaaacacgtaaacgtcctggtttttcacaaggtattggagcatatcgtatgcggtgaaggcgacggtatgctcatcgggcgttcttgcaaaaacaatgccgcggaacagctcttttccgttccatttgaacaaaaccgtatccccttctgatacgccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgccccggctgccggatattccgtttgctgcgcttaatcatggcggttttattcgcgttccagattttccgccactccgtgtgttttccgtaaaacttgccggcgatgtcccaaagcgtatccccttttttgacggtatatgttttgggtgaagctttggacgggcgcttcgctttcgtttttttcttttgtttgatttttcttggcgaagcggttttatattctttcagtacgatatcaaaattccggtcgccgatttcattgtcaccttcgctgtaattaaagctttcaatgctgcatgtgacattgatttttgtccctgtaatcaaaaactgaacgggttttttcgctttcatccatgcttcaatggctgaaatggctttttccggtgaaggaatgctttgatattcggcaatcgggctgtaccgtttcggaaaaaaagaagagaacgaaatttctttcgctcccggttcttcgataaacgtcacctctccaagtccggtgactttcacggaatcattctgcacgctgtttgcgatatcaatcgcttcagggagaacgggaagccggagcttgtccttcccttgagacagccaaaattcgtaaacagatttagtcaaaagcaacggccccctttgctccggtataaatgtctttttgcagttcatcaatcagcgcctgtttgattttggcggctaggctctcggcgtcctgcccgttatggaaatgctgatcgccgctgaattcgattttaatttcttttgttcccgttttttgaacggtttggccgccgcctttaacggctgcggaaaccgtgccggctgaaagcgccgccggttccgtccgggacggatcggacacttccatgccgagcgcctgagccgctttttgcagcagatatcggccgcggatgccccgctcttcaggaatgatccactcccgtttattcccttcaccgacacgggcgatctgctccttagtgatcaaaccaccattggcataaccgacgtatgggccgccgcgcgccaggctcttaatcccgggcacattgtttatcgatccgtatctgcttttaatatagccgatagcggcagcggcgttgtggattggatttctgatatcattcatgcccggcgctttgtgatcttcaaaggtgctcggaatcgtctgcataagcccctgtgacgggtgtccggctttggcgttgctgtcccatagattaatggaattagggttgccgcctgactcatgctgtgcgatcgtcattaatcccggaagccagctgatcggcgtattggttgctttcattgcggccaaaagccattctttgacgcttcctcccgctgcacccataccggaaaaggctgctgcaagcgagcctgcctgtttttccgcatattttttcacgtcaactgagctgagacctttgacgacgccgactgaagcaaagcgtccgagactcatcatgacacgggaaggagagtgaatatcaagctcttccctgaatgcgtcctcgacttttttggccatatctttggccgcctgtttgacttcgcttccttttgcagtcattcctgatacgaagtgtccgatcaggcctgacccccagccgttcgcggaatctcttgattgcacaaacggtttattgatatgtgtgcttacgtattgcgacgttcccgtatcttttgcattctgtccggccgaataacctttcactgtggcggcgccccatgatgacgattgattaaccgccgattgataaggtgttttcacctttgtttttaaaaacgaatcggtgcccgtcggcgatgtattctgacctttggcatagcccgcagcgacttgctttccgtaatcgggcgaagacgaaataagggcgttaaacggcgttccgatgtttttctccttccagccgtccatgtccaccgctttattgctgattccgctgtcaaagccttcagtaaactgtttgccgagtgatgaagccgtccccgcaaatccggaagcatccacagacgcagcggccgatacagacgccgaagaagaaacaccgcccgctcccgccggcacagcagaagattgagttgaagccgcacccatatcatcgacaacacgcatgccgagcttagacgcagcttgtgaaagcagcatcttcccccggccgcgattgttgtcgacggggatgacaaattcttttccggcttcaccgatccaggaaatggtcggctttgtaatgtagccgcccgtggcgtttttgtccggttttttctttttatctccgccgcctgtgacgaagtccattacgcctgaaatcaatttgccgccggttttatcccaaatctttttcacccagtcgaatgctgcagaaaaagcatctgatatggctgttcccacttttacaagaggttcttttatatgtttctcaaaccagccgcttaaccctttccatatatcctttaccgtatctaaagcagtcgtgaaagcgtctgatattccttttccgactttttccaccatgtttttcaccgggttccagacaatatccatgaaccagccggataccgtactgaaaacagatttaattttatcccaagctcctgtgattttactccaaatggacgtcgctactccgacgacagccgattttacgggctcccagacagtgctcataaaccagccggatactgtgctgaagacaccttgaatcgtcgtccacgcattcacaatatttgaccagatgcttgtcgccactccgacgacagccgttgaaaccggcgtccatacattctccatgaaccaggatgacaccgtgctgaaaatcccttgaatcgtcgtccacgcattcacaatatttgaccagatgcttgtcgccactccgacgacagccgttgaaaccggcgtccatacattttccatgaaccaggatgaaacgcttccccaagtatcttgtattgttgtccaagcactttgcgccgcttcggaaatatcattccatgtgtctttcaaagcccctgaatcaaaggcctctcccaagctggaaccgcctaaactgccggcgatgccgcctaccgcgccgccgattaatgtgcccactccgggaacaacgctgccgattgccgctccggccgcggctcctgcaagaccgccgcctgctgagccgaccttctctcctgcattatctttattgatgccggctaaatcagtaagtgataacaattcacctatgccgggaattcctttagcggcaccttttaaccctttcataccgcctttcagcgcctttgaatctcctaagcctttcaaaagcccgccgatgcctttacctgccccttttgttttcggcgtgtttacggatgcctgtttgctttcctttacggaggaacctcttttcgaagatttattccgcccttcgactttactgcttttgcccctcgtcactccggtacagcagcagcagccccccaaagccccgccggtttttttggctgaccttcctgaagatttcggtgatggtcccgtgcgctgcggaccctttgtcagctcaggacgcttcgggctgttggtgccgccggcagaaaggctccccttactcttttcttttttcgtgccgcctcctaataatccgccgatattgagtttgcctaatttttcagcgattcctgaaaatattttttctattaattccccggctttttccatgattttgtccgggctgaatttctcaaatttcttggcaatcttgctgacaattttatcaacaaatgcctcggctttttcgatgatcgcatcagggctgaacttgccgaactttttatcaatgcctccgaacagtgaggaagtaaactgctccactttttccagaatcttatccggattgagaaaatcgaatttctcagaaattcggtcaatcgtgtcatttacaaattgttcggcgcggtcgattagcttatcaggactgaatttaccgacaacgtcgtcgactttcttcataaacgaatcagtaaaatgatccagctctttcaatatggtctccggactgaatttgctgacaacgtcatcaacctttttcataaatgaatcagtgaatttatccagttctttcaatatggcttccggactgaatttactcacgaccccgtctacctttttcataaacgaatcagcgaatttttccagctcggctaatatcgtctccgggctg

SEQ ID NO: 131 - DNA, 43248 bp, Bacillus velezensis FL50S
cggttatccccgttgctccggatgggcctgttgctcctgttatccccgttgctccagttgggccggttgttcccgttcccccagttacacccgttaccccagtcgctccggttgggccggttacacccgtcgctcctcttgccccggttgcaccagttactcccgtcgctcctcttgcgccggtcactcctgttggacccgtcactcctgtgggacctgtaattcctgttacgccaggttcacccccggtttgcgccaatgaaacgtcatctattaaaaccgtgccggaagaaactttacttaatacaatgacggcagaggctgcgccagaaggcacactgcttgttttatagatttcagaccatgtgtgaaagagcacgttcggcaaatttccgggtgtgatattttcttgaatggaactgatttgttcacctgctgcgctgacatagatgatctggagagtgacttggggacttggctcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccaccccgctaatgtgccggtttcaaagcttccgtttataatcggattattcattcaatctttttccctctccttcccgttgttgaccgtcttacttattaagacagcatattaatacgggctgtgttttgacaacctaaataaaaaaggtgatttcttttcatcaccttaatccgatccttgaatggggaatcccgtcgcaatgagggagcggtttgccgctgcgacttgtgttacgtagttcgaagaaaggacagataaatagagctgatacgcggctgtttcatccgccttcatttcgtcgatgtacgtaaaaggaattcctatgatttgcccgcctgaagaaaagaggttcctctcttgtctctgtgtttgtatcgatacgccatttctttgcagattgacagctaagaccaatgagaaatgagacgcgagcggatctaattccacatttacttgtatgacggcatccgttttcaccaattgatctgtcggcgcagctatcactgcgcttaacacgtttatcggtgttccttctaacggaatcgtcattagttctgctgtattttgaaaagctaccgcaggaaccgctcccggcggaccctcaggccccgggggaccgggcggaccgggcggacccgcctccccttgcggaccgcgggagccggcgggtcctcttttgccttcgggacctcgcagcccgggtacgcacaaggcagatcgattttcatctgaagacggaaaccgtttttccgtccctgtttccggactttcaagttcacatggtaattgttcataccggcgtttcatatgtctgctcatatatttgtaaggtttctgtttcaatatcatgtattgattacggccgctgctcataatatcaccccggcaatattctattcgcattgaagtcatcatgtgcaggcccttcccattccttaccgaaataaaaaaaggcagacctgagtctgccttttttcttctaccataaccctaatactttccaccataatccgccgatcacaagccatgtcacaatatggacgattgacaggataaagccgatggaccaccatttgctttgcgatatataacccgctccgaaaaagaccggagccgctcctgagccgtaatgcgtcgtcgaaccgaaaaggttgctgaaaaacgccaggctgagcgccgccaacagcggcggagcgcctgccgccacgatgacggcgagaaatgcagcatacatggcactgatatgcgcggttgcgctcgcaaagaagtaatgcgtgtaataatacacgacaatcagaatcataaatgccacaatccatgaaaaaccggaaacagatgatttcatcatatcgctgaaccaagacaccatgccgagctcattcaggaaattcgccagcatcacaagcgccgcgaaccaagtcagcgtatcccatgcaccttgttcctttttgatgtcctcccatgttaatacctgtgacaaaagcaaaacggataatccgatcagggccgtcgtcgttgcgtcgatatttaagcttcctccgaaaatccacagcgcaagcaccaataaaaagacgatgaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcgtgggccagcttggcgatcagcgggttcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaaaagcagtgaataagaaaggccgagtgttttcttcccgaaccgttgtacgaatacgtaagaaatcctggcgccgagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatcccctatcccattttactacttaactaagttaataaacgtttttgttaattaaaaaacacaaaggaatattttcctttgtgcttcttgtttattattttaatatacccgacccggctttagatataacatctgattttacatttgatgatgagccgatggaaccgtgcaatgacggtgtccagccgacggactgacttaatccgttggcggctgacgcgttaattgcggcgccgtttaaaagagtgccgtcttcatgaagcgcttttccgccgctgaagacgctgatgactttatcagcagccagtcccggcacttcaaagacattattctgggcatatatttttgacgcgtggcctgcgccccacgcatagctgaacgggtatgcggcgcttttagagcctgcgtaaaaattattataaatatgaacctgcccgtaccggacccgcggtgcgcgctggacgatgttctggtaatagttatggtgaatggtcaccttcagttttccttcatccgacgtcttgctgtcgctgtttccgatgacggagcctttgtcatggtcatgatatttattataggacaatgtaatataattcgccccgttggctatatccgtctggccgtcatgatgctgatattttcttccgtaatagtagggaaaaccgctgtcgggatttgatccgtcattaaaggtgcaatgatcgatccagatatgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacgccgttctttatattaaaacttccgcctgtcactttggcatttgaacccgaaccgatgatcgtcgtattggaaggaatgtcaatcacgacccgtgctttctggtttttttgagatcgctgtctggcgtcttcctgggtgcctgacggcgcttttttcccccatttgtccgggtcgtacgccttcagataagcgttgagatcatatgccggatctttataatcattaaagccgagcgttttattccggtcgtccgtattcatattgattgtgccttgtatgtaaataatcttcggcgtgctgttggcgcttccccctaatgcagaaacgagctgctgtctgtttgatacggtgtatacattcgatgaagaggctttcgcgccgccggttgtcccgccggaagcggctccccagccgtcatttgttcctaacgtctgccgtcccaggtcagcggcatagacgtccgcagggatcatacataaacaaaccgccagcataaataacatttttttcatgaattgtgctcctcctgatttttcgttccaatttattacaattgaattctatcaaatcagttgagaaacggcaccgaaaatgtacagcatgtgcctttcggttttattgcggaaaccgcaaaaaaatcccaagggaccgaaaaccccttgggatctgttcagcttacgcccatgattttactttttcgttatccgtgacaaatagaagaacttttccttcatctaagcgcttttcaaattgtgatgcttcctcttctgaaaagccgatttcgtgaattttgttgcggagctcgtcgccttttttattaaacatattgccgaccgcgtgtttaatgcccgtttctttcgctccgatggtattgacatcagtattatctgccaggcggtccgttctgtcgtcatcatgagaaagcacatatacgtcttcttttgcgacacccaattgctgaagctcttttacgtcctgcatcagtttttgatcatttgtatattctcttactaccggtttcattgataagtcctcccttttgtttttgtatattggatgtttacccgctcaaccaaaggtcaaacaaaagaaagagagttccgggaaaaaacgggcagattgtcggtggatattttccggcgggacatgttacagtagggaaagtaacttttatcagaaaaataaaaatcttcatgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccgacagaaattgaaaataagctgggttcttatctgaccgcgcttcagcccgtgattacctctgacatgcttcattcttcaaaaacgaatgcctatgaatatttggaacatgagaaaaacaccgatgtgtaccggttattcttttaaatacgcatataagaaaagaagggccgtggcccttctttttttgttgccggcggacggtttgattttgtattcgggaaatggttcgtgttacatttggaacaaccacttatcttgaaggaggattcagtatgccgaataatcagcagcagattcaattggcaagacgcccgaaaggcgttcccgtccatgacgatttccgctttgaaacgattgccgttcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgccgaagttctgacagacggcgataagctgaaaaaaggagatgttgtgatcggaaatctcgcatggcaggaatattcagccgtcaatgagtccgccctccgcaagttggatacggatatcgcacccgcccaggcgtatctcggcattttagggatgaccggactgaccgcttacttcggcctgcttgatatcggccgtccgaaaaaaggcgaaaccgtcgtcgtttcaggggctgcgggcgccgtcggctcaacggtcgggcagattgccaaaatcaaaggcgcgcgggttgtcggcatcgccggttctgacgaaaaaatcgcgtatctgaaagaggagcttcaatttgatgaagccattaattacaaaacggcggatgatattcaaaaagcgcttgaacaggcatgccctgacggcgtcgatgtctattttgacaatgtcggcggaccgatttcagatgcggtgataaacctgctgaatgaattcgcccgcattccggtatgcggagcgatctcttcatataataccgaaagtgaagaggaagacatgggcccccgcgtccagccgaagctgatcaaaacaaaagcactgatgcaggggttcatcgtcagtgattatgctgaccgcttttccgaaggcgcgaaacaattggccgaatggctcaaggacgggaagcttcattatgaagaaacgattacggaaggattcagccatattcctgacgcgttcctcggtttgtttaaaggagaaaacaaaggcaaacagatcatcaaagtcagtgatctaggttaacatgatgatgaaaaaaggagggctttgtcccctccttttctgctttttcgcatcagccgcgaagaatcaaagtaagaaagccgtcttcatcaggctccgtattttccaaagtgaatcccgctgcttgaaagcagactaaactgatttgattgtctttttagatgcttgccgcccattcccgcacgccggtaaacccaggatcagtcagcagtttttgcaagatctgttttccgtacccttgaagctggtacaaaggattgacgatcaatccgatatacgcccgttcctccacaaactctatagagactatacctgccggaagctgcccgtcatatgccataatgacagtatcgtcttcatctttattcaatcgtgcataccacgcgtctaatggcagcatcgcatccattctccgtctgatgttatcgttcttaaaccagtgttcaagtattttcagctcacgttccttcaatatttgaaatcggtctattgaacccatcttcccactcccccgcctgaaccttttctattatttcacaataaaaaagaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggccggatctgtggatatatccgtcttcattcgggatgtctgcgtgaatgacgtacggaagatcatcgatatcaagtccgcgcgccgctatgtcagtcgccagaagcagcggaaattctcccccttcaaacgctgataatatctttgcccgctccatttttttcgcttctccgtgcaggatgccgagatccacgtgatgataggcgagtttttccgcatagacgcttaaatttccgatatctctgacaaacacgagcgcctgcatgccgttcagccgtgacagcttttgcaatagcttcactttatcccgctgatcgcagacgagatattgatgcgtgacgcgcgctttttccgccgtattccgctccactttcaaaacggccggttcatgtgcgatggcattcagcacctcttctgtctccggctgcagcgtagcggaaaagcttaaaagctgtcggtctttcagcgtcgttttaatgatttttttcatcgtttcgcggtgttcctttgtcacgagctgatccgcttcatcaagaacgatcgtcttgacttcatgcattttcagctttttcgcctgaatcaattcgagcaccctgcccggtgtgcctgcaatgatatgcggtttatttttgagcttctccacctgctttttcacgtttgccccgccgatcaaagacaaagcgcgaagatcggagccttttttccactcctgaatcacttgaaaaatctgcatcacaagctcgcgggacggcgctaaaatgatcacttgcggatgtttctgttccgggttgatccgctccagaaccggaagcgtgtacgccaatgtttttcccgttcccgtcggggattcggcaatgacgtctttcccttccatgatcacctgagcggctttttcctgaataacggtcggctcctgaaaacctgacgcctcccagttttcggcgataaatggttgtgtatgctgtaaaaatggccatgtttgggtcatgtcgttctcctcaattcttaaaatctactccatagtatctcaaatgcacgcggcaaacgcaattttctttttccttccaagccttttaacaaacggtctcctcctttataatcataaatgagaaagacacatgataaaaaaagcgtgtctgataacgatagaggtgtaatgatgagtattttatccgtaaaagatttaagccacggcttcggtgaccgtgcgctttttaacaatgtatcgttccgtcttttaaaaggggaacacgtcggcttaatcggagcaaacggcgaaggtaaatcaacgtttatgaatattattaccggaaagcttgagcctgatgagggtaaggttgaatgggcgaaaaacgtgcgtgtcggctatctcgatcagcataccgtgcttgaaaaaggaaaaacgatccgcgacgtgctgaaggatgcgttccattacttatttgcgatggaagaagaaatgaacgagatttacaacaaaatgggcgaagcggaccctgatgagcttgagcagctgcttgaagatgtcggtgtcattcaggacgccctgacaaacaatgatttctacgtgattgacagcaaagttgaagaaatcgcccgcggcctcggcctgcaggaagtcggcctagaccgcgacgtcactgacttaagcggcggacagcggacgaaagtgctgctcgccaaactgcttttggaaaagccggaaatccttctgttggacgaaccgacgaactaccttgatgaacagcatattgaatggctgaaacgctatttgcaggaatatgaaaatgcgttcatcttaatttctcacgacattccgtttttaaacagcgtaatcaatttgatttaccatgtggaaaaccaggagctgacgcgttatgtcggcgattatcatcagtttatggaagtctacgaagtgaaaaaacagcagctcgaagccgcctacaaaaaacagcagcaggaagtggctgagctgaaagatttcgtcgcccgcaacaaagcccgcgtcagcacgagaaatatggcgatgtcccgtcagaaaaagcttgataagatggatatgatcgaactggcggccgaaaaaccgaaaccggaattccatttcaagcctgcgagaacgtcaggcaagctcatttttgaaacgaaggacttagtcatcggttacgatactccgctgtcacgcccgctcaatctcagaatggagcgcggacagaaagtcgccctgtacggcgcaaacggcatcgggaaaacgacgctgttaaaaagcctgctcggtgaaatccagccgctggaaggcacggtggagcgcggcgagcatcaatacacgggctatttcgagcaggaagtgaaagaaaccaataacaatacgtgcatcgaagaagtgtggagtgaatttccttcctttacccagtacgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcccgtgcggaagttcctttttttaatgtccggcttttattccggcaagatgtttgcgtcccataagaagaacaagcatgccgacaaaaacgacaatcccgcctactgtatatggtgtgcttgcggtgaagtgttctgacagcattcccgcaatccacggagcgagcgcaccgccgataaagcggactgagctgtaggctgaagacgcgattgaacgttcaaccggcgcagcacccatcacagcggttgtcatgatcgtattcaccataccgaggacagcaccggcaacaacgatacatgtaatgatcaacgtctgatggtcagtccagacccccataataacgagaatggccgcaaaggcgataaagagaacgacgagcgaacgcactgtgcccagcgctttgtgcacaagcggcgccgtaaagactgacgtaattgccagcagaaggccccagccgaagaagacatatccgagaccgtgttcatctaaatccagaacgaacggagaataagcaagcaaaataaaaaatccaaagttgtataggaatgcagatactgccattgtcaaaaggcctttatatttgagcgccttcatcgcatcaaacacaccgacgcgtttcgccggtttcggcagcttcggcagcatgagtgaaatcgcgcaaagcgctatgagcatgaggacagacactccgaagaacggagcgcgccatgaaatgctgccaagctctccgccggcaagcggcccgacggaaatccccagtccgagcgcggcctcatacagaataatggctttggcgctgccgccgacagataccccgacaatgacggcaagcgcggttgaaataaagagagcattcccaagcccccagccgccgcgatagccgacaagctgagcgattgaacttgagcttccgccgagagcggcaaacacgatgataaaaataagtccgagaagcagcgtccattttgcgccgatccggcttgaaatcgccccggagaaaaacatcataaaaccggtaacgagtaaataacttgtaaataacagagatacttcactaggtgaagcatgtaattgtgcggcgattgccggaagaatcggatcgacaagaccgattcccataaaggaaatcacacaggcaaacgcaaccgcccaaacggctttcggctggctgaataagcctgttttctgttgtgatgatgtatccatttgaccagacctcctgtttcatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagttcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgtaaactttttatgccggataaacttggcttggacggaacctttgtctttaaagcgccgggagacatctgtgtaagataaaaaaagccggtatgacccgccgtcttctcgggggccgtaccggcttttcttaattctcaagttcttcaatcatcagtgacaattcggtccagcgttccatcgccgcttcaagctcttcagccgtttttgcctgttcggccatcagttcttgtatctttccgaaatcacttcccgcttcagcgatttccatttccagacgctgatgcttttcttcaaggccggcgattttgtcttcgatgccgtcccattcgatctgatccttgtacgaaagctttttgcgctttttcttcggctcttcttccgcctttttctcttcggccggctgttttaccgccgtcttcttctcttttgcttgttccatgtattcactgtatgaaccttggaaacgggaaatgacaccgtgtccttcaaatacgatcaggcggtccacgacgcggtcaaggaaatagcggtcatgggatacagtgatgacgacgcccgggaactgttcgatataatcctcgagcacgcttaatgtttctgtgtccagatcattggtcggctcatctaaaaacagcacattcggctcctgcatcagtacattcagcaagtacagacggcgtttttccccgcctgacagctttctgatatatgtctgctgcatcggacgcgggaacagaaaacgctcaagcatttgttccgcggtgatgacatcgccttccgccgttttgacgatttcagccgtctcttttatatattcaatgactttcatatcgccgttcatttcgctgtgatcctgggtgtagtagccgatccggaccgtctgcccgatggtgatattgccgctgtcaggctgaattctgccggcgaggctgtttaaaagtgtcgttttcccgattccgttcggcccgatgatgcctattcgttcccccgggatgacaagctcattaaactggctgatcagcgcttggccgttataggtaatggcgacgttatcggcttcgattacttgttttccgagacggtgggaaccgatcgcgaaatcgagtgatccggagactgccggccctttttgctccttgagcgcctccgctctgtccactctcgctttttgtttcgtcgagcgcgctttcgctcctcttctgagccacgccaattcgcggcgcaggaggttttgtcgttttgtttctttctgctctgccagcgcctcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcaggtgtttctgacgctggtcattttccggttcttcattcagcgcctgaagcgctttttcgtactctctcatcgttctcatgacggctgatccgccggaataaatatgttcaagaacggtttgtccggccggaagctcagggtcctgatgcaagaactcaatatgcacgtttcctgaagccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctggaataaaactagtaaaaggacagacaaatttcttggaagagatcattttgtccgaagaatgtttccgcctctccttttatacactggaggggaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgcggccgcccgtaattttgtgttttcgaaagcggaaatggattatattctgtggctggacgccgacgatatgctgacggtaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaggtatacggaaacatcatagaaaccgatattgccgtcacacaccggaaatccgaaaaaaagcactcgcctccctcggaccgcaacttgaagatttatgagagaatggcggaaaacagtgaatcgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagggcgtgttttggtatgagctcgccctatccgccaaaagcagtgatgcaggctttacccagctcgaatattccacctggtacccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcgaaaaaaagagctgcccccgtatgaagggcagctcctttttgattacgctgtcggaattcctccgcttacactgtaaatttgggatgtcacataactcgattcttctgaggccaaaaagacataaattcctgccagctccgccggctgtccggcacgctgtaatggaacggccggtgtttccttgccgaatttcggaatgttttctccgggctgtcctcctgaaatctgcagcggtgtccagatcggccccggcgctaccgagttgactctgattcctttattcgccagctgctttcctaggccgacggtaaaaccgataatggcatgtttcgtcgcagcataatccaacagcatcgggcttggattatacccttctacggacgttgtcgtgataatagacgcgccttccggcagatacggaagcgcggctttgacgagccaatacagcgagaatacgttgacttcaaatgtttgatagatttgttctgtagtaagatcgctgatatcatccactgcctgctgtttgccggcgacaagagcgagcgtgtcaagaccgccaagctcttgatacgctttttccgccaattctccgcaaaacgcttcatcgcttaaatctcccggcagcagaacagcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagcttgtttcaccgcagtccggcacaggcttcatctctttctgcaaaccgggcggttcttgatattgttttggaaattcatcatgatcatatttcgtcagcgggttgtgcagatttgcatcagacatacaagactctcctttatcattggtgatgtattcgtatgtgtacccctgagcatgacggatcaaacgtgtaagtgcagtttccgattgataagggaaaacaaaaaaggagcccgtaagctccctttttttatgattctccgagcacgttttcagccattttcgctaaatgctgggcgcttcctgaaatctcctgcatcgtggcagaaatttgttctaccgccgccgcttggccgtccgtgttctggttgatggattcaattgagtcctccagccctttcagcaggctgtggatttttttcgtaatctggtcaatttgaccgacattgtcttttgaatgagtggcaagcttgcggatctcatccgccaccacggaaaagcccttgccggattctcctgctctcgcggcttcaatggccgcattcaaaccgagcagattgctttgatccgagatgcccttgacagtgacggaaatgtcggcgatttctcccgcgctttcactgacttgtttcgcctgagcggaaatcccggtcatctgtgctgagaaaccgctgatggattctgagatatccgcgatcgccgaagcggtctgttccacgacggcggacaggctttcagcgacatcatgaagcttggctgatttttcaaggctcgtgccgagaccgacgccgccgatgacttttccgttttcatcatgaagcggaatcgctctggcgatcagcggaaatccgaacagctctttcggcaccatgcttgtcttcttctgattcatgcggatcgcgtctgtaatgatgtcccctttttgcagcggatctcccggctttacattaagagaaaacgttttagccggaatattcacgattaatttttctgtatcataaattccgatggtgatgtcatcttggatcaggctgtttaaaaaaggcgcaactttgacaaaagcgtcaagcaggctgtgcgtttgctgctccgtctgtatactcatttctttcactccttcttaatatgggaattggcgtttttcatgctgaaccgaaatccatttcagcgtggtgaattcttcaaggctccattcgccgttcagcctgccgagacctgattgtttctcgccgccgaacgcgacgttcggttcatcattaatggtcgtatcgttgacgtgaatcatgccggtttcgatccgcttagcaaactcaacgccccgctccacgtttgccgtatgcacggctccgcttaaaccgaacggtgtcgcgtttgcgatgcttaccgcttcatcctccgtttcaaacggcatgatgcagacggccggtccgaacagctcctccttcgcgatgctcatctcaggtttcaaatcttttaaaatgacgggctcagcgaccgttccgctgaatcggccggacagcaccggaaccgctccctcttctatcgctttttcgacagaccgtctcaggccttccgcctgtctctcattgattaaaggaccgataaccgtatcagggtccatcggatcgccgactttcagcgatgacactttcgcttcgtaaagctctgtaaatttgtcataaacagatgtgtgaacgagcacgcggttcgccgacatacagatctgtccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgcggcacgggatgctcaacaaagctgtcgccgatctccccgatatccgtcacgatgacattcagcagcccgtccggtacgccggccgcttcaaaaattttcgcgataagcgttccgccgcagatcggcgtttcttcatgaggcttcagcacgacgccgttccccgcgccgagtgccggcgcaacagatttcatcgaaaggaaaaacgggaaattaaacgggctgatcacccctgcgactccggcaggtattctgtacagcctgttttcttttccgtcaatcgtggacgggagaattttcccttccatccgcaccggaaatgttgcggcttcttttatcatatttttgacaagtccgatttcaaactcagccttcagccgtgttccgccaagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcaggcgtcgcttttcggaatgaggtgatgactttttgagtataaggatttctgttttccaatacgttccggctgctcccatccctccatcggccgccgataaactgcttatttagttcttcatattgaaacatgtaaacatctccctttcaccgaaacttgaaattagttgatgagtcatcttttgtatcggtcttaaggtgagaaaattgaactatttcacaataaaattccctttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgttactctcggggagtgtctcgcgtttttaatcggatgggacttaatgcttgaatatgttatcgcgctcgccgccgtcgcaaccggctggtcatcctatttccagtcgcttcttgcaggattcgggctgcatcttccggaggcgctgaccgccgcacccggcagcaaaacgggtgccgtgttcaacctgccggccgttatcattattttggtcattaccgcgattgtttcaaggggcgtgaaagaaagcacccgctttaacaatgtcattgtattgatgaaaattgcgatcattctgctgtttatcgtcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgcctgtcggaatcatcggcgcgcttgccatctgcaccgttctttacattacggtatcgctcgtcctgacaggaatgctttcgtacaccaagctgaatgtcggagatccggtatctttcgcgctccaatttgtcggccagaacaaaatagcaggcattatttccgtcggcgcgattatcgggattacaacggtcatgctcgctctgctttacgctcaggtgcgcctaacatttgcgatgagcagagacggccttttgccccgcatgttttccaaggttcacccgcgttttaaaacaccgtttcaaaacacatgggtgacggggatcgctgccgccgggatcgcaggttttattgatctgggaaccttggcgcatctcgtcaatatgggaaccttggcggcctttacagtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtggtatatatgatgtattcgagaaaacacagtttgttaaataaataaaaagggaggctcttttttctgtttgagaaagaagagccttttttgcccttgataattcattcaccttatgaataatatggtgtatgcttcgtttacataaaaaggaggagaatcactttggcaattgccgccccgcttaaagaaaaacctgtccatcgtcccgagacaaccatgtattctattttgttcattatcgggatctgtcatctgctgaacgattcactgcaagcggtgattccggcgatgtttccgattttggaacgttccatgaatcttacatttacgcagctcggaattatcgcctttacgctgaatatggtgtcttccgtgatgcagcccgtcatcggctggtatacggataaacgcccgatgccgtatgctttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcttacatggccgccggcgaaaagcgcggattggcgcaatcgatttaccaagtcggagggaataccggccaggcgatggcgcccttgattaccgcgctgattctcgttccgctcggtcaattcggctctgtctggtttacgctagtcgccgcaatcgctgtgctgtttctcatttatatcgccaaatggtataaaggccgccttattcatttgcgcgccgcaagtaaaaaatcaccggccgccgctgtgcagaccgtgattacaaaaccgattattcttgcacttatcatgattatcttcttaattttcgcgcgctcctggtatgtgagcgcgatcggcaacttctatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcatcgtttccatgacggcatcggctcccttgacgattttccttccgtttgcgggacctgtcatcgcctatggcgtactggcgctgatcggcgttgttctgatgtccagcttctccgtgacggttgtctacgcgcaggagcttgttcccggcaaaatcggaacgatgtcagggcttacggtcgggctcgccttcggaatgggcgcgatcggagcggttgcgctcggagctcttattgattcagcgggattgacgccgaccatgacagccgtcgcctttctgcccgttttaggtctgctcgcctttgtcctgccgagcgacaaaacattaaaagaatggcattcataaaaaaatccctgccgaaaaggcagggattttatgtttcaaccgtataaaaatgagtgtcaggaaccgcatatttcggaataaacccgtctctgaaatcaggaaacgctttttgaatttcatcaatccatttttttacgtttttgatgtacgggacgtaaatcatactgactgtcgcctcatcatcaatgtgatagtaccagcagagattgaattcgttctccgtgacgagcgtaaagcctgaaaaatgataaaaaatcagcggggtgtcattgacatatacagccccgtcgcgcaggctgacgtcatattgctcaatattccacagcgccgcattcgcgccgatcgactccgtgacatgcacgtgttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacagctcgcccgcatctgagaagaaaaagagatcggtgtccaaatgggcaaaatattcggcttcatcatactccgtcatcacatggaacagaaaagccggcttcagcgtccagcaatattcatgaaacgtccggccgccctttgcttcaagaagctccgggtcctccatttcatggagctgaaccgctgtgacatgttcccacggcacctgctgaagcagttcgtacgctttctgatcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagtcagcgctttgaacgcccttgcaaagtgcgtgacgcccagctttttttccgcttttgccaaaagctttccgacctccggcagctggaagctgttcgccgtgatccgcgggcttttcgtcttccagtccggatcgaggttgcggtctttaaccgcgtgcagcagttcgagaaaaatgtgcagcaggctttcatatttctcataatcaagcagcacttcgatgtctgccattatgctgttggttaactccgcgtcaaacgggccgttaaacgcgaggtgcacgtcaagcgaatgaatgtcattgtacttgtcgcacatgtacgcgatattcgccctgatgtcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacaggccgagatctgccacgtgctgcctcttaactgatgaattgttcgtaatgaaaaaacgccatggcagacggtagccgttcaaatcatctccgtatttttccaaaatgcttttcagcacccggataaagtcggtatctaaatcaaagcatcgttcaagaaagcttccgtctctgatgtcactttcatcaaggagcggctctttatcgcccggcagctcttcatacagttcggcgagtttttccttatgctctttttcaaaacggtcataataaaagctgtaaatccgcttccagaacataccgcatacgacaagatcgtcccggttctcatgagccttgatatgcttcgccaccaaatccttttcggcaagcatgtcgctgtcatggaaaatcaaaatatcgcctctggcattgcggaccgcctgattccggccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagcctctccttggaattatatgcgggaacaatgacgcttgccttcacttttcgttcacttcctgtatatgatcatttatttgttatcatcctcagatgcaaagccgctgaactcggggcagacggcgctgaccgtcccgatcacccgcttcagaatgtcctgataaagctgatggacaaacggcaggtcggtccggtccgtctcatgaatctgccgaatgtcgccggctgtgacgatccggtatccgctgaaatgatagaaaatcagcggatttccgtcttcgagcacaagacgcccgtccttccatgaaaacgtgtggcggccgtaattccaatggccgatattcacgccgggcgtggtgatgtcacacacgttcgggaacagaccggacatgtaatccaagtagccttgatctccgaattttccttcgcccggcgcatttttgcattcttcaaggcagcgttctttccaccatctgagacaatctgtgccggcactgtcggttttgaagctgagaaaaccggaattataccggcctaaaagacgctgcagcatgtcgatttcctgtttttcaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatccggacgcattgcctgaagcacgtcataggtgtcttgatccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccattcgatcgttttttctaatccttcatcaatggtatgcgcgggcgtccaattcagaagcttcctcgccttttccgctgataaatattggtgcttgatttcgtggcttccctggttaagcactttcggcttgaggtcactgtccatcgccttaagaattttttctacaagttccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaataaatcggcacagctttttgatacgtcatacggatgtttgccctgaagaggcatgttttcatcgtacggcagtgtcggctggtcgccgtacgctttatcactggacgcgacgatcacccgcttgatgagcggatgcctgcggcacgcttcaaggatgttccatgtgccgagaatattggcttcaaatgtggaaatcggattgcggtttgcgacgccgacgattgcctgagcggctaaatgaaagaccgtgtcaatttcatactcgcccagcgcccgctcaatcacatccagatcttcaagcgcgccctgcacgatattcatttgcttcacttgttctccctgatacaggttcgacttgggcacagtgtcacggacaagtcccgtcacattagccccctgatcgatcagttccttcaccaagcagcttcctaaaagacctgtacatcccgtcacaaacacatttttatttttccagaaactcaaacttgatcaccataccttccatacatgttgtccccggtcccacatcttgttaatttccagcagatttttatacgtatcgatcgccgtccagaaaccgtaatgccggtataccgccaatttgccgtcctttgccagctccttcagcggttcttcttcaaacatgacgtccctgtctttcggcagataatcaaataccttcgggctgagcacgaaaaatccgccgttgatgatgccgtcacttgaggttttttcagaaaagcttttcgccataccgtcttcaaccgtcagcgttccgaattgcgaggtcttttctataccggtgacggttgccgcagccccttttgattgatgatagctgatcagatgaaacaggttgatgttcgccagtccgtccccgtacgtcataagaaaggtttcatcaccgatgatgtccttcgcctgtaaaagccgccccgctgtctgcgtgtgttcccccgtgtctaaaaaagtgattttccacggctcggatgttcccaatatccgcacttctccggtagagctgtccagcgtcatgctgtgattcttccagtcataatctaagaaatattccttaatcatctctcctttgaaaccaagaagcaggataaattcgtttacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaaccaacccgataatttgtccgattctctaccaccggtttcaaaatctactgtaagatatgagagattggcgccctttgtgaccaaaagctctctcttttttcagattggtgaagatacacaaaaaaagagcctcacggaaattccgtaaggctctttctattatttattatcctgattcagcttttctttgccgtaatgatatttagacggatcaaccggcgtaaagtcgctcaatttgtggaatctgagcaagtctttgtacatcacgctgtcagacagcttcagctgctctgtgactctggctttcaggtttttcgtttcctgattgcctttcagttctttccctgtcttcgtatcgtatacgacattggagatggaagtatatttcggcgtgacgtaatctccgttgcggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtaatggtctccgtaaagcataatcaccgagttgtcatataaaccggatgacttcagatctttaaagaactgttcaagcgcttcgtcaagataacgcgccgtctggaaatagtcatccacagtcgcgtcgccagttttcgctttttcgatcgttgcgtctttttcatcaagcgtaaacggataatggttcgtcagcgtgagcaaatgcgcgtagaacggctgtttcagcgactgaagcttcggtatagattctttgaagaacggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtaacttctttcccgtcaagtttgtaattgatcaaaaacgattggaagctctccagatgaatcttaatgatatttttgcctttggccttgccgaaatactcggcgttcggcttcgcataatgcgacgatgtgtagttttcaacgctcgtcaggtcatcactgctggcatatgcacgctgtgattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaacacaatacccgtcacgataattaatgacgtataccgttttttcagcttgaattccttcagctcacgtctccacaccagaagcgcgattaaaataataatatcaacaaagtataaaatatcatggccggacataatgctgaagatgccgtctcccatatttccgacattaccggattgctttaagttcgggaatgtcaagaaatcatcgaagaatcgatagaataggatattggcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccattttaaaaaacgatatatttatcattcgtgtcatgcctattgaacatcttatcccgccagccattagacgcaggatatccgttcttcgtttcacatttttttctggcattaaaaggtaccttatcagacccggtctgaaaataggagataccaaatataagaataacacaaacttctaaaaacgaaaaatgaatatcaaagacagccgcccaacaggcgggctgaagttattgtatgcaaagggactgaaaaacttgaaggttttttttgggtgatgtaaaaaaaggaccggagtcatccagtccttttcatcacatcgctcaaatccccgcccaaacatcttttgcgtaaatgccttttgtctggaggtccaaaagccattcttgcgcttgccgttcgtctgtttcgcggaccgactgatacgctttttgcagcgttgcctctacatcgggcgccattttgctgccgtctccgcatacgtagaggtgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgctgcccgagcctgcagaaatccgcggaacggggcgactcctgtgccgggaccgaccataataatcggtttttccggatcttccggcagccggaatcgtgtttccggagtgcggacaaacatcacgataccatcctcagggcggcggtccgctaaataattcgaagcgactccgcgatactcacccaaaccgctccgggcggggccgcgaacgacgccgacggtaattgaggcctgcccgggatgtttccgaggcgaacttgaaatcgaataataccgcggcttcagcgggcgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcggacagaccgtataagcggccatttcccggatttgagcccttgatgccgcttcctgcaattcgacacagctgctcagaagatcatgcagcctgaccggccgatcgagcgggagatgagccgcgctctgtccgctggccgtcagcagcacttgatcattcccgttcagattgaaccggcggagaacacggctgacctgctttttgctgtttaccggcagcacgccgagatgatccccttcatgataggcagcctctttcggcagagtgatttcgatatgccttgtgctccggccgctttccggcgcctgaagttccctgttttccgcaacggatgcgtaaaccgcttcatacgtctgtgccaacggagacccgccaagcccgctgacaaattgaaggcccagcgcacttcgctctttttcggcattttcattcagcttaagaccgaatgccttcatggcgtccgtccacatgctttttttccattcatcaagctttccttcaaaatccccgctgacgtccccttcgcctcgggcagaaaagcgttccgcccctttttcggcaagcttctcatcaatcagtctcggcacagcctgatatgtcgccgcccagttatgatcaccgcagccgaagacggcatatcggacaccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagttcccgcgccacgccttctgcggttcccgtatctgagccgtacaaaatcagaagcggtcggttatcaagcccgataatggatgcgccttttgtttcccgtttttctttttcgacgtcttccgccgctttttcagccgccgggagagctgccgcaacggctcctttgtttctcggccgcacccggatatgaaagtcgccgggcttaatcgtcagtgtctgtttaatatcgagctcataatcggtgtgatcgataaaggtaaaatgctgcagaatcatccccagaacaagagttgcttcatgcagggcgaactgcataccgatacacgccctctgcccgtttccgaaaggcttatacgcatggtgaggcactagatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataagcgcaatgactcctgcaaaatcattcggatataactaagctccagtacttgtttataagaaggaacgggatcggtcaaaaccccatcggcttcttcataggctttttccaaaacacggggatgtttcagcagaaaatagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccgtccgcctgaccggcgctctgcgataatactgtctactaacgaaaacatcgcctgaatgtcatgatgaaattggcgcttcgtcctgatcatgagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcagcaggcacatcaacggcctcatccgggttcagcctagcccatttttgaatcagctgcaccgcgatatcagtcatcatcgcatgataatctttcatcgcgcgctggctgaaggtcggcatcagaatattatgcgcctttcgccagttaggctcatgcgtccagcttgtaaacagcccgtcaccggcaaacgcccggactttctccaaagcaccttcaatgcttttatcgaaccgctcttcatcacatacctctttcaccagttcatgtccggacacgacgataatggcgcccgccggggtatgcagctgaaaaataggcccctgctcgtttgccagtttgatcagcgacattgtaggcttgtctttatcaagcaaaggaagattgccgagaggaccgaatgtcttcggctgcggaatcggacctgtttccttcatgaataacaccctttcttacacattgatgcgttccttccaactacagtgcccttttcaccggccaattatccgccgttacggatcaatccccggattgacgattgataacggttttttctatactggagaggcttgttaaatacagaaataaggtgagttcacatatggattttgaaatcaagtttttatcgttttatgtcattcaagtggaaggaaaagacgaacaggcaaacaaacagttcaaacatttccagacccttgacacagaagaatttgaagaaagcgagctgaaggattttcttgacggggaattgaagaaaatcgtcaaacggaaagctgaacggcatccgcaatccgagcaggtccccacaaaaatcggccattttatcacggagcctggccatgagcttgattcaaatccgaattacaaccttttcaaccgcgccagacttgcggatacgaaggaagcatttatcgaggcaagcgaacagttcgtccgtacttatcttgacacgagcgccgtgcgcggcggtgtttttatcgtggcttcggccgttccgcgcaaatattttgaggacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatatggcgaatcgatgccggaaatcatgaaaaaccaagtcatgaacatggtgcaggagcacgtgtatgaaacttttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggcgaatccatccatctcgcaaaagtgaacgggcgctatgtcgcgctcattgaggcggagacgatctcgtttgaaaaaggcagttcgccggtggagtttcacaagcctgaggggctgcatgaggtgattgagcggatacggaataaatctgaacaagactgacaaaagtccagacgccatgttctggactttctgtatttaataaggctctttgagcaatcgatagcattcaccgatgatgtcttggacgccgggcgttccctttatctcgcggcggacgatttcagatgagagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaattccgcgcagcaagtctctcacccgttcaaaacgcgtgtcctcgtcatccctgaagtcagcgtcatacggccggatgataaatacgtatcctgttttttcagagagcggcacgaccccgacctgcgtctgcccctttttatacatcagtgtcgaatcatgaaaaaccggctcgggaaaagaaatgtaaaatctgtgcgctcccatgccgagatactctgttttcacttccctttgcagcatgtgattgcggacagcggagcggatgccgtcaaagccggcgaggatgtcagccgtcatcgcggttccgtctccacaatgcaccgttatttcatctgccgtttcttcgtaagacacgacttttttaccgggcagaatcgtgacccccgccgcctcagcatgcttgctgaggatatcgtttaatgtttgccgcaatatattattccgccccggcaatgaatcatctaaaaacgcctcactcactttaaactgcagcgttccgttttcatcatgctgcttcagccaatccgtttgaaagccgtgttgacagcattcatcatacacaccgatttcccgaagcacccgaagcgcattttgaggctgaagaatgcccgctccgctttttcgcatgtcggacgccgcctcgcaaagggttacttcaaaacccgctctgccgagagaaatcgctgcggacaggccgccgatccctccgcccgctatgatgatctttttcacttcatggttcatcacgataccgccttctcaatttatttatcatttgttaactattagccaccttactatattggctgaaaaactgtcaatctttataggttgccttttgaatccggcaagcttatactttgaatcactaaaatggtacggaggcttacaaaatggaattgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgaacccggccacagcctgagtccgacggagctggcgaaaaaatccaatgtcaccaaagcgaccatcaccggattgatcgacggactcgcacgggacggctttgtaaaccgcagccggcataccggtgacagacgaaaaatcagcatcgaacttacaagggaaggaaaagaaaagctgatgctgtttcttcccggccacttctccaacatttcaggagtcatggaaagcttcaccgctggagaaaaagcggaattgacaaaaatgcttgaagttttatttgataagcttctgctgttttccggagacagaacataaagtagtattgtaaaaacaaaggcaaatttctatgagatagaaattgaagtaaaaagatgagggttataaaaaaacagcctgcacattagtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgcccccatatgatgctacacaatcaatagaagtagcttttgcagaataagaatccgcatcggtacaaactctcaatacatatgttgcataatctgtactacaaggcataatatccttcccctttcaaattttttgaaacaggtttgttattatgacaaaccctccgttcacttctagctggcaaacgtatgacaaaggggatctcatggcttatgagattaaaaattcaaaactcttagaattaacaaaaggcgcccttcttagcagggcgcctttttcgcgcgattaatcatcactgtttaaaatcccgaaaaaccgaagcaggttgataaacaagttgataaagtcgatataaagcgtcaatgccatcaaaggaatcaggtcagccgtgatgtcccggtgcttgatctggttcagatcgtataagatgtacattgaaaacacaattgttccgatgacggaatacgccatcatggcggcggaattcagcgggctgaaaatattaaagatccccactgcgagaagcgcgataagagcgacaagcaagaaggaccataaaaacgacaagtcctttttcgttttagcgccgatcgtaccgagcaccgcaaaaatcacaaacgcagaaccgaatgcctccaatacgacataggctccggctgcggacgcataatggctgatgatcggaaacagcgtcattccggaaataaaagcgaatgaaaagacaaacacatatccgacggctttttttcggcgcagccaaaatgcggcgatgatcatgacgacctccaagaccgacagcggcagcatcaatgccggcggaatgaactggcccgtatacaggccgattgtcgcaactaacagtgtaaacacaaataccgtgataatgcgctgcataatagattgtttgctctcataagcagcagtttgcatgtcaaaagtcctcccaaaaaatgatcgtgataggtctattataaataaaatgggagaaatttgcatgattttaagaagattttaaggatgtcaggcctgacgttttgctgcgcactcctgcatatccatgaaatcatgcagttttttcgtcaatccgccgtgcccgaatcggatattccccttctgccccggcgttttcacgaaatcaaggaatgccagcacataaagacgcctgacgggaatcggaatgacgcccgcatcataaaaccagccgtcaattgtattgagcacgcctttatttatgccgtattgcttcgtgcaccaatgcagaaagcgcacttcgggcaggtgcagataccggctctcccggaaaggaacagttgaatgcttcatatgtaccgcctcctgtcattggctgttttttaagatggttttacttctttgctcttcagggaaaatcgatatttctccaccttatcaatttgtgtcacttgggaattatgaaccgtaatctgaacagtcccgaaatcgagcgtttccagcgcactgataatcttttcgatcacatgcggatctacgtttcctttggacgtcatcatgctccccctttatgtctggacgttcgtcttttgacaatgagtgttttaattcatactattctgataagaaatatataattatactattatgttttcattcagaaatcaacagcatttacacaattttcggatatgttttctttgcgaaaactttcacttccttcgctttaacataaaccgtgtcgccgacgcccgcccccaaggcgtcatattgctgtttttaagaacgcaatcttcacgttccgacatgtttaaattgttttccgctgacaaaaaaagcgccccgcctctggacggagcaccttttttctatgcttttgcttcctcgataacacatgtgacacccatgctggcgagcgcctgctccagagagccgtaagtttgatactctgaaaaatcaagtcccaattggatagaagtctgtgccacatcaggccgaatgccggaaaacacggttctgatgccgaggagaaataacgttttcgacagcatatataattgctgcgccaccatcgtatcgacaatgggcacaccggacagatcaattacaaggtttgtgatccgtttggcgacacagttttccggcaccgactccaaaatcacacgcgcccgtctcgtatcaatcgcgccgatgagcggcagagtgccgatcgtatccgcgatcaaaataaccggacagctcaattcagaaataagctcctgctgagatgacagcctcgcgatcattaatttctgaaactgttcagtaaaatccgtcatcagctgatcaaacgagccgttgacaaggtaattccagcggcgggcatcctcatttgttacaatgtcctgatgctcatccataaaacgggtgaccgcctcccaaaagacggttcttgaattgccgatcgcctcaacgacctcatgaacctccgcgtcttgctccactctgcttttcgctacctgagcggcccatttttctttgttatgctgaaaaacggccggatcttccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcgccgatcgcactagagaaattaaaaaaacctgcacattaaagcttttgattgcttttttcggcaggaggatacactataaaagaaatgaaacaggaggtcagtatgatgatcaaaaaaatcgcgacagtcgccgtatacactgatgatcagcaaaaagcgaaaacattctggacggaaaaagcggggtttgaaaccgtcgccgagcatccgatgggaccgggcgccttctggcttgaggtagcgcccaaaggggccgccactcatttggttatttatccgaaatcgatgatgaaaggcgccgagcatatgaaggcttctatcgtatttgagtgtgaagatgtctttgccgcatatgaacagatgaaaaggaacggcatcacctttttagatgaaccgaaacaaatggaatggggcagcttcgtgcaatttaaagatgaggatggtcatgtctttctcctgaaatcgtaatccgtcaggcatcttaattgactttgagaatcattttcatttaaaatgttggataaagcgtaaaaaggattggagagctgccagatgtttgtgcaaatcagaaaaatgaccgtaaaagaaggacatgccgacaaagtaatcgaacgcttcagttcagaaggcgtgattgaaaagcaggaaggtttgatagacgtaacgatcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcaaacggcaggacaaacagcggtttatcgggcttccattccgcatacagcacgtcctccgtttttttgatgttcagctttttcagctcctgattcagctgcttttcttccagcccggcttctttcagattttcatacagcacttcgccgtcaataatcagcgtgaccggcaaagagacctgcttcggctttatttgcatgtcgccgtttttcgtcgtgtcatattgaaatttcggcaggacgctgaccatcccgtttgtttctaaaattgcgtactccgcttcctgtatagaaaagcaattcgcctgtctgagaaggctttgcaattgattaatgtccagcttattctttttcagcacatcatatttcagttttcctttatgtatgataatactcggctcgccctccaacagctttctggagctttttactttctgcgtaatcagttcgatgagataaattaaaaccccccataacagagaagcaaaaatgatttcaataatcctgacgcctttatcatacaccgcatttccgaccagttcgccgaggatgagcgcggaaataaaatcaaacggcgtaatttgcgagaattgagtttttccaagcaattttaaaatcacaaataaaatacccaagccgcatactaactcccaagccactgtaagtaaatgtcccatatttgcaccttcttcttaaaagtcattaccattatggacattcgcctgttttctatacagcggccggcaatacacaaaaaaacgcagccgaggctgcgtttttttcacttctgcttactgtttttgattcgatctgacgacccgtaagcatacctcagcggcataaccggcggccgctccggaacccgcaaacatcgcggcaagccccaagcccatgccttcccagccgccgacaccgaaaatgctgtaaacaaccgtaccgaaagcagtcaggcccagcaccgccaaaagccactcaggccacatctttttcggccatttcttacggagcacagccgatacggcaaagttaagacaaaatgcggccagacagatcagataaaaaaaccccatgtcttttgcacctccgtcatgaggagctttttatttgctcacctttttttcaaacaaatgataacccggcgcgattccttttgattcgtaccccattctgctgtaaaacgactgaagcgccttgtttccgaacacgcagtcgagccggattttcgtttttcccggacaagacacacccgtctccgcccaagtcatgattgtccggccgagccccgcccctgcaaaccgcctgttaatcgccagccggtggagatatacggactcctcatgtccttcatcgccccatagacgtctgtcccacccgcttgcttcgggaagcagcatgacgacgccggccagctcttcattctgcctgaataaaaaaacataccctttggcgatcgcctcccgcatattgtggggatcttccccttgcagaaggccgctccactggttcgaccctttatcgcgaagccattctgccgcctgcacgagcagatccatgacctcttcttcatcatccttccgggcggaggtgacccggaatgcccccgccttctcctccgtaatcgtaaatggtgtcataaaatcctcctgtaatcagaatattcgacacctttattatagaccaaacgcagaaaggaaaaaaacagccgtcatgtttgagggccgtttaaaaaattttcttcttatcacgttcttcttttaaaatctcaaccgcttccctgaaacgcatagagtgaacgatttcacgctcacgcagaaaacggagtgaatcattcaggtcaggatcatcggaaatatcaataatccattgatacgtcgctctcgccttttcttcagccgcaatatcctcatataaatcagcaatcggatctcccttcgcctgtatgtaagacgctgtgaacggaacgccggccgcattgtgataaaacagcgcgctgtcatggttgacgtaatgatcactgagccctgcatcacgcagctgctccggtgtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcacgtactcactttaaccggatactgcagctttttttcatatacccacatttacagatccctccttatacttgccatggccaaggaccgcggccccagtcccattgagcgccggcctgactcacgccgaattgcagaagcggtccgtactcaggctcaaaccgttttctcagctgccttgagtaccgggaatattcatgaaactgctgaagcgcgagacggtcatggggatgcgtatccagataaagcgtcagctccaccaagacaaagtccgccgcctgaatttgctccagcagccgatagtattcatcatcaatctttttcgccatattcgattcccccccgataaggattatcatagaaatcgtaaagatccttccaaagggtcccttttcttaatgcctccatcggagaaaactgctccaagtgataaggctgaaaccgcatataaagatgcggcggcgttctgtagtattttctcccgatcggcgggcagggatcaaaccggctgtggaagggtttataggatttgaccggtgtaaacggctgattttctttcattacgatcctcctttcctaaacacatgaccttaataggtatgaatccgtatcggcatttatgccctgtaagaaaataaaaaagcccgttaaaaacggactccatgcagctcatctggaatttgaagtgaaaaaatcataatgaaaaatctgattgaaagcactgataatgtttcaatgtatattccgtaatttgctgatcatattcaggatattcgtatctcaataaaacagccactgactttgaatatgctctgaagagaccttggcagtcaaacaatgccttccacacgctttcataagtattgccgacataagtattcagcagaatttcccaatccttcgcattcatgtaatgttgaatatacttataattcttccctacacttaatgaaaactgatgctctatcccgatattccacgcaatcatacgcaaaacattaggccttaaaatgtcattcatatgatccagcgcaaacagtatttctttacgcattaatcctttaatcacataggtcgaaaccatccaaaattcattgcagcaatcatcaaactctccgggggtcggtttctttatatgatattgttcatcactcgcaatcatcttactgttgattcggtcatccttgtctaataatatttccgccaaaccatcactctgtgtaaaataatcctctgtttgactcagagggatcaaagttaagtcgattttatgatgatctttaaaaagcatgagataggagaaccagtctccgagttccggagggaaaagttccatatcttcaggtttttgcatcatcattctttcgccaaactgatccagccagctttcatcagatataaaagagtccatatcggtcacaaaataagaaatatcatagtcttgaaatttgtctcgcggtacatttttattggttcttgatccctctaaagtgacaagacggattctctcgtccttcatcgcaatatcaagaatcaatttcatcatttcgtcttcacttctcacatgtaaaacctcccgataaagagatttttacagatcatgcttttcagtttataaacaacttgctcatgatttacagaaatgtcatatgtacttgatgattttgctccaatcgtaccacagctgcaagaacatgagaagagcactcttgctgttccaagagtgcttttcccgaatggtcagatatattggctgtcccgatgatgatggtgatggaacgggtagccgccgtagcctccgccatagccgccaaaaccgtacccc

SEQ ID NO: 132 - DNA, 38322 bp, Bacillus velezensis FL50S
aaacttgtgatgtctgactgatactctctataaaaactcctagagaatctaaatagtttaattcgttttcaaataacatacttgtaaaaacaatcggaaaaacagctttccttctatctataccattaaattcacagtattctctggtaaactctattccatcaaaatcattatgtgataggcatttaaagaagttatcctgaatattttttacttcttcccaaaaatgatttaaattattgaagcatacatcaaatatcataatttctgtaaaatcgcctataacgttattaatttgcttatgcaaaggtcttcttttaaataatgtagtgtttaacgcaatattctgctgattactccatttagacaacacttttgaataaatagccaaaagtagtatactaggtctaatattcttctgagagcataaattcacaaattgattccaatttcttttctcaataatttttttctttcttttaaaagtaggtttttttatacatgttatatctacttttactggcagagctggtgttgaaggaaaacctttaagtttatttaaccaatattccttgtcattctgatatttatgattttcctttaattttttataagctaacatataatctctatagcttatttccaatggcaccatttcatcttttccattataaaattcagatatctgtttaaataaaagctggatactagctccatctgctattaacatatcgatatcaaagaatattctatatagattatcactgatttttaaagctttaaattcaaacaatggccattggtatggatcgaatattcgttcgttagttacttttcttgcttctaatattttgtcttcttggtctggttttttaagataactcacatcttgaatagctaatttataattcggtacgtgttcaagtattttttgcttaccatttgataaaaaaactgcacgtagcatgtgttgacgctctatcacagcttgtaaacttttattgaatttttcaatatctagttcagcctcaaattctacaaaagcatgagtggaagttccccctagttcaaattgcttgtctcttccagataaataagcaacttgaacatttgtaagatcaaattctttataggtattttcttcatcgtttaataaatgtattgtattatgctcttttttattatctaataactgaaacttttcatatacaacttgacaaaatgacagtacatctgggttgtcaatataatcataaaattcaatatttatattatatgtatcttcaatggctccaagtaattttaatatattcatagaagatatttgataatcaaaaatattagttcttaaatcaactgaatcatctttacttaattcacgaattttttttattataaagttagaaatctctttaaacttattactcgttactagcgtgttattaatcaatgttttacctccttgttctttagtcctacctctaccgaatgtaaatagatttcattgctattcaaattaaattcatctttaattttatcgaagtctatttctcctatggagcacgatccaacatcaaaatattctgctatattagccaatgtagctgacataacaccacattcgagaataccatagtaataccctgtccccttatatttgggcatgattacatcacaatcaagagtgaaaaagatagagaaattcgaagtattaaatgcactgtggtttataaaataatgatattttttttcagccagttttactctattaagtaaattgatagagtgactatgagggttataaaaatataccccttcctcaagattttcgactctcccatctttaatatacaaatatatgttgacaggatacagtcctcctgcacttgggtagaaatatttaataccctcttgaattggagactgtttaaagacatttaacaaacgactaaacttagaaaaattcattattttactagtatcaaaattcctagtactttttctattttgaactacagagggcaaatctgaacattcctctaaatcaaatgattgaagagtattctttgacataaacctagttaattgtttcttcttataagattctatattttctttatataaaaaaaactcctcatcatattcttgataaacaaatttgttttgcgtttcgaaaagctctgtcggtgtgcttacattgcaaactaaaactctattacgtattaaatcttttagaaacatttttaaaatttttggattaaagtctttaaaaataacatatatttcgcttaaaggaatgcctttttgaaaatgaaaataaatatcaggaaaaagatcaactactttccctctaaattgaaaatcattaataataatatggttattttcatttctccagtgaacatgaggagcccaaaagtattttttcacgttaaaaacctccatactaaacttatactaataatttatctttaataattgatataacttctgtaacggattcattaataaaaaaatgccctccgttaatctggtatacatcaacctttttttctgaatattctttccacccttcaacttctcttatagttaatgattcgtcaaacttgcctgttaaaacagttaatgtaacatttgataattttttttaatattgtggttgtaactttctattagtttataatcatttcttattactggaagaaatagtttcattagttcataattctcgataagatccttgggaatccctcctaatttgtttaaccattgaataacttgtttatcaggaagaccgcttataaatgtttccttagttaaataaggtgcgccttttccagatacaaataaatgctgaggaagattatctgtaaccttcattaatttaagtattacttcataagatatatatgcacccatactatggccgtaaatcgcatagcacttattatcacactttcttaatattaattctgtaatgtcatctatagcctgatttattgttttgtaggacttttcagaaaatctagagcctcttcctgctagctcaacaggtattagttcaatttctggtccaactgagttactccagtcactataaatacttgacaatcctccagcatgcggaatgcaaaaaagtttaattggataggtcattagctcctcctttttcaaaaaaacccatgaaaaaccaacttttaaataataataaggaattattgtctatttgtaaagtattaatttggaattttaatagatttaaagtaatggttatcttaatacatttgttattttataatatattgggtctaaaatacatattatgaataatattgacaccaatgattttttttcttattatgttttttagacatacgtcaaagttttaattagattatgttctaaaaggagatgtaagtatattgaatttcaaaaaattaattatgttatctgcattattattaggtacattcatttcggtaatggacaccactatagtaaatattgcattacctaagatgctggattacttttcgagcaacctttctcaagtagcttgggtggctacaggttatactttagcttttgcagttttattagtaggtgcatcaaagctggcagaccattttggaagaaaaaaagcttttatgtttggattagcactttttattttgacatcagttattgcctgtttgagcacttcaattgaaatgcttatcacaattagagtgattcagggattatctgctgctttcattgtgccagttacaatgcctattgctttggccatcgttcctcaaaataaaaaaggattgatcattggaatctggggggctttctcaggattagcagctactttaggacctgtacttggaggattattaactgaaaattttaattggcaagctatcttcttcataaatattcctttaggcctgatttctctttttttagcagcattttttattactgagagttatgatgaaacagtgagtaaaaaaattgattacatggggattcttattttatccggagctctcttctgtttaacctttggctttgcaaaagtatctgatttaggctggtcatcaccattaattatctctctttttgtaatctctgtattattattctgtttgtttttctttattgaatctaaaattaaaaacccgatgattcccttatccatgctgaagatacgtacgtttagtttcagttctttcaccctctttatgcagggccttggattaacaagcggtacccttattattactttactcctcacgaatttaatgggaaaaactgaattagaagcggggttaattgtttctacattagctctatcatctatgtttacctctgtactttctggaaagctatctgataaactcgggggcatttggctttcgggtctaggtatgctcggtttaacaatcacaacatatttatatggatacatacgatacgacagttctgtaacaacggtaattattctgttatgtttgaccggcttagctttagggcttgtgataggaccggcaatgagttcagggatacggcttattcctcctgagaaagtaggtattgcctcaggtattcttaatatgatgcggacagttggacaagcgctaggcattgccatacttacatctgtgcttacaatgaatataaatgatcacacagcttctgcaaaaaaagaagccataacaattgtggaaaacaatcaggtttttgataaaaatgcaaaaaacgagataataactcacttaaagcattcagacagtaaaggtttcgatcgaagaaaaagtattgctgaattaaacaaaaaagaggaagaaattctttctataaccccggatccatataaagaaaaggtacaaaaaagtttcaatactcaaaagaaggaagttatcgctatccagaaaaaaatttcaaatttatataatgaaaaaataagtgacagttttaataatacattcaaagtaggcagtgtaattcttattttaggaattatttttgcattgttcagtgatatttctccaaaacgattaaaacaacaacagaaaaaccaggtagatattacgccttgaccgttccataattgtttcattgttccgctccatcattcatgctacaattttaggatgcatctgatgtgagggaggctttttgaacattgaacgagaataacccttttccttattcaaatacggaaaaacggtaccatacattaaattatcatctgcgggagcatttcgggcataaagtgtttaaagtcgcgcttgacggcggttttgactgcccgaatcgggacggcacggttgcacacggcggctgcacattctgcagcgcggcgggctccggcgattttgccggcaaccgggccgatgacttactcacgcaatttcacgatatcaaaaaccgtatgcacgaaaagtggaaagacggcaaatatatcgcatatttccaggcgttcacgaatacgcatgccccggtagaggagctgcgtgaaaaatttgaatccgtcctcaagcttgacggcgttgtcggcatgtctatcgccacccgtccggactgcctgccggacgatgtcgtggaatatttggcagaactgaatgagcggacctatttgtgggttgaactcgggctgcagaccgtgcatgagcggaccgcactcctgatcaaccgcgcccatgattttgactgctatgttgagggtgtcaataaactgagaaaacacggcatccgcgtttgttcccatatcattaacgggcttccgcttgaaaacagggacatgatgatggagacggccaaagccgtcgctgatttggatgtgcaaggcattaaaattcacctgcttcacttattaaaaggcacaccgatggtgaagcaatatgaaaaaggaaagctggagttcctttctcaagaagaatatgtaagtcttgtatgtgatcagctcgaaatcattcccccggaaatgatcgttcaccgcattacgggagacgggccgatcgaattaatggtcgggccgatgtggagcgtcaataagtgggaagtactgggcgccattcaaaaagagctggaaacacggggaagctatcaaggaaagctcttcagaaagatcggggaggagaccgccctatgaccttgatgcacatcctccctttcagtaaagaattgctgaagtccgccgcacaggaaggtgatatcacggttgacgcgacgatgggcaacggacatgatacatattttctggccggccttgtcggtgagacaggacatgtccatgcctttgatattcaagcggacgcactcgctaaaacgaaggagcggctcggtgccgacttcggcccgcgcgtcacgcttcaccataaaagccatgatcaaataaaggcatcgctgcctgaagatgcgcacggtcgtgtggcttgcgccgtctttaatctcggctatctgccaggcggcgataaaagcattacgacaaacggtcactcaaccatttccgcgatcgaacagctccttgaactgctgaaggagaacgggctgatcgttctcgttgtgtaccacgggcatcctgaaggcaagacggaaaaaagtgcattactggaatactgcagcaatcttgatcaggaaaaagcccgcgtgctgagctacggctttctcaaccagcaaaacgacccgccgtttattatagcgattgaaaagaaatctgccggcaaataaagaatgggcctgtcataagcgggccgattctttttgtgtttacttttcaagaaaaatcaattactatgaaataatggaaaaaagttcatcttttaagcgtaacatctgagaggagcggcagtttgaatattcttcgcatcatattttcaagtgttccctatgtaatgtttgtcatcattttatcaagacatttaggatttgagttcgcgaaaacctattactgatggtttgctgcattttttgtcatcgggctgatcggcaaattcgcaatgcaccttgcggcaaaaaagaaaccgttaaaaaaagagacagcgtaaaatgcgcatgtctctttttatttactgttttgcagcacgctgcgtgtataagcgggattgttcgtaaagacaccatctgctttttgtttcagcataataggcgtcagcgtatgctcgtcttccttatcaaaaaacacgtgcactttcatcttattgtgatgaatgcgcttcacgactgcttcatttgccaatttggcgttgatcccgactgtatcagcatacgttctgatggtttgcagctgcttatcatttatctcctcagcctcgttatcttttaataatcgaacaagaggaacttttttattcatagaatgaactttctttaagctcttcccgctaaaagactcaatgactgctttatggccggaaatcagcttatgtttttgtaatatgtcaatcagtttcttttccatcaccaggctgccgttgctttctcttgtctcaatatagtaattggcagtttgtccgaatttctgtatgatttcttctaatgttaaaatcttttctccttttcccgcattcagtttcttaatctgagccaaagacagatcatctgtcatccctttaccatctgttgtccgatctaccgttttatcgtgaattgcaatcagacggccgtccttcgtctcccgtaagtctatctcaatataatctgctttgtctttaatcgcacgtgcataagacaaagcggtatgttccggctcaatcgcagaagagcccctgtgcgctatcaagacaggatgatagccggcggaagcatgggtgacggagcagcctccggaaatggaaagtaatgctatgaccgctaaatactttaattttttcataaaattaaagtatcatattctgcaggcgcacacaatgtttcattcttcacatcataaataaaaaactgcgccgtcatgatgtacacgagaggcgcagttcacccattacgaacttttcgtccaagccatcttctgaaatttgcggtaggctcttccgttgatataaaagaaaaatgacgtttttccgcttgccctgatcagctttcgcgcgaggcggcccatttctttttggccggcgactttgtcatcggataaatagacgccgagcagccccctgttgatcagccggtgaaaattttcatgcggaatgccttgcaaatgttcatccgctttttcaataaaatgctgcagtctctgcatcatttcttcatgagactgataatacgtacagaaattcagatcgccttcaagcagatcctcttcctggtcaattaaataatcgagcagtatgtgcagcccttgtatgtacggaaaataactgctgcggattttctcagcggtatgttcgttaaaatcaggctggaatgagtaagcaacgagacagaaaatgcctagcgtcgatccggcgcaggccgagaattcaaaccactccatttccggaagctgtgaccggtactgctcaaaccaggctttaagcctcggaacgcgttcatgctcaacgacatgcttatgaacctgaagatcgcaataataatcacacagctcaagcaaataaggtttaatgataccgtaatgttctattgacccgagcacccgctggcatgttctgaccagctcatgaagataaccgccgtcatcccgctcctctctgtactgatagtacggccgcacctcggcaccgaccgtcagcgcgtcacgcatggaaagatgaagcatgcggaagtccttcggatcaagcgaggtgctgcggtcgcacagattgtccagataatcactgattgtctgatacgcgatgataaattgcacgcatttctgtttctgctctcccgaaagcagggctaaaatgccgcctccttcacaatgaaacgacttatcgcggatacttgcggccgcctgctgccgcagttcggtatttttaatggaatctgatttttcccgccacatgttcaattcctgatgaacgagcggaaaaatttcccgatacacttttgccataaggttaaaaggatgttccggtactgtcaacatatgcacccccagcgaattcaaatatactgatctgtaaaggcttttgccgccttaaacacagtttctctttccggttcattaaaaatttcatgataaagcccttcccattcccggtacgatttattatgggaagccacaccggaaaaccatttgcggaccttcattttatcgacgattttgtcatcaccgccctgcataagcaaaagcggcacctttaaaaacgcatcagtcggcaccatagcggcatcaatggtttttaaaagctctctgtaccatcttacggataccttcgtgacatataaagaatcgttttgatccgcttcaatcatatccgcattcctcgttgccatatcaggtgataagccggaatccactctgagggacggagcgaggacgttcagtcctttagacgcaaaatcaaggactttattgacttttatttgcagacccagacaaggtgatgataaaatgagtgccgtaatgcggggatttctctgctgcttaaaccattctatcgcaatcagtccgcccatgctgtggcccaaaaggaaaacgggcgcttcaagcgttctcgctttatcaatccatatatctacttcatcaatgtattcttggaaagagcgaatatgccctctggcgcgggtcgacgttccctgaccgggcaaatcgcccatcaccacgttatatccggaagatctccacatttcaacgagccatttataacgcccgtggtattcgctcgccccgtggataatgacaatggtaccgacgggcctgtctgctttccaagtccacatgcagttcacctcttacataaatttagagaaagaaggatgagacatgataatctacccttataaacaatttacgccggacatacatcctgaagcgttcattgcggataacgccgtcataacgggcgacgtcgtgatcggagaacaatcgagcatctggttctcggcagtcatccggggggatgttgcgccgacaaggatcggaaaaagagtcagcatacaagacttgagctgtctgcatcaaagcccgaaccgcccgcttcttattgaagatgacgtcacgatcggccatcaggttacactgcacagtgcaatcatcagaaagaatgctttaatcggtatgggctccgtcattcttgacggggcggaaatcggagaaggcgcgtttatcggcgccggaagtctcgttcctccgggcaaaaccattcctcccggctgtcttgcgttcggccggcccgcaaaggttatccgccggctgacagaagaagacatacgggacatggaaagaatcagaacggaatatgttgaaaaaggccgatactataaaacaatgcaagagaaataaaaaagatcagctttgttttactactgtaccatttttcaaaatattatttaagtaaaaaccatttgcattctcccgattatcaggaaacagaagcaaaatgttcaggaatttgttttattcttcccccttttacccgatcctatgaaaaaagagcccatttcagcgggctctttttttacgctttttcggcgaatgtctgtccgttttccagatctatgtcttttcttttatggaaacctttgccgtaataggcggctaataatatgccgaaccagacaggaccgatgatgacggccaccctggtctctgcatcaaaagccatcagcacaacgacaaaagccagaaatgccagcgagatatatgaggaaaaggggtataaaggcattttatatttgagttttttccgttcttccggctgtaagcttttacggtatttcatttgggaaagcaaaataatcgaccatgtccaaattgctccgaacgtcgcaatgctcgtcacccacgtaaacactttcgccggcaccacgtagttcagcaaaacgccgatgcataacgcacccgctgaaaccaataccgcttttcccggcacaccgccttttgtgaccgtaccgtatgctttaggcgcttcattttgctccgccagattgaacagcatacgccccgtgctgaagatcccgctgttgcaggaagaaagagccgccgtcaatacgacaaaattaatgattccggctgcagcgggtattccgattttttcaaatgtcaaaacaaacgggcttccgcctgaaccgatttcctgccacggataaattgacataatgacaaacaaagctccgacgtaaaaaatgagaatgcgccaaaaaacagtatctatggcccgtgccagtgatttttccggatttttgacctcaccggctgtgacaccgatcagttcaatcccgagataggcaaacatgaccatctgaagcgacagcagcacccctttaatcccattcgggaaaaagccgccgtggctccataaattgctgattccgagcgcaacgcctccgtttccgagaccgaatacgatcatcaccagaccgatcgcgatcattgacagaatcgccaagactttaatgagcgcaaaccagaattcaagctcaccgtacgctttgaccgccagaaagttgacagccgtcataatgacgagtgcacaaagcgcccagatccatgacggcacgtcagggaaccagtagcccatataaatgccgaccgcggtgatttccgccatgcaggtaacgacccataaaaaccaataattccagcctgttaaaaacccggcaagcgggccgatataatctctggcataccggctgaatgaaccggctacaggcttttgaatcgccatttcccccaatgcccgcataataaaaaacataatcagtccgctgcaggcgtaagcggctaaaatccccggcccggcaagctttatggcagaagcagacccgagaaacagcccgactccaatcgcggcgcccaacgacataagcgagatatgccgctcttccaagccgcggtgaagcgttttttctttgttttgcataactctccctccccctgattttgacaaagaaacaacaaaccgagacgaaatagccagaaaactctttccggaatctacccgattagtcctattataacctttttctgaatattgcgtaatactttgtcgaaaacagagcggaatagacggtttacaaaaaacaatagaaaaaaggctttcgataactcgaaagccttttggattaaacgaaaatgacttctttcggctgatgattcagctcttccggcaccagtcttttttcgacattgatgctgtgccagatcatgaagatcagcacggtccagattttgcggctgttgtccgctctgtcggcacaatgatcttccagaagctgaaggacataatccttttcaatataagcgtctgtttcactttcgcgaatgatgttgcgaacccattcgttcatttcatttttcagccagtggcggatcggcacagggaagccgagttttttgcggttaagcacatgatcaggcactaccccttcagcagctttgcgcagaaggtatttcgtcgtgccgtttttcgttttcaattcatccggaatttttgaagctacgtcaaacacgactttatcaaggaacggcacgcgcagttccaatgagttggccatcgtcattttgtcagcctttaacaggatgtcgccgcgcatccacgtatggatgtcaacatactgcattttattaatgtcgctgtatgaacggctttccgtaaagtacggcttcgtgacatcacggtatgaaagctctggattgtaatgtttgagcagctgttttttcacgggctcttcaaaaatcttcgcattaccgatatagcgctcctcaagcggtgtgcagccgcggactaagaggcttttccctctcattccttcaggcatgacggacgccacatgaagaagcatttttttcagaccggacggaatgcgttcaaacggtttaagcgaaagcggttcgcggtaaatattgtacccgccgaacagctcgtccgcgccttccccggataacgcgaccgttacatgttttttcgcttctttcgcgacaaagtacaaaggaatcgccgccggatctgcaagcgggtcatcaaagtgccagacgattttcggaagctcgttcatatactcctcaggagaaatgactttgctgatattttcaataccgagcgcggcagccgtttccttcgctacgtcaacctcactgaagccctgctgctcaaaaccgacggaaaatgttttaaggctcgggtgaaattctttcgcaactgaaacgataaaagaagagtcgataccgccggatagaaacgaaccgacaggaacgtcacttctcatgtgaactttgacagagtcaaagattgcgtctctgacttctttcaccaatttatcttcatcagactgaacaggcttgaagttcgctttgaaatatgttttaaacgcgatgtcgccttccgggcggatcgtaaactggctgcccggctcgacttttttcacttcagcgtcaagcgtgctcggttcaggaacgaattggaaagacatatattgctgtaaagaagctgtatcaagatcaataccgttttgagcggccattaaactctttctttcagatgcaaaatatactttgtccccgatggttgtgtaatacagcggtttaattccgaacgggtctctcgcgccgtacatgacgcgctcagctttgttccagattaaaaacgcaaacattccgcgaagctttgaagcggcttcttctttataatgacggtatgtcgcaaggagcacttcggtatcggaatctgtattgaaagtgtagcctttcgcttcaagctcttctctcaattcaatgtagttatagatttcgccgttaaaaatgatccaatatttttcgtcttcatatgataaaggctgtccgccgttttctacgtcaataatactgagccgtctgaagccgaatccgacgtgctcgtcatgataatacccatcgctgtcaggaccgcggtgaacgatcatttggttcatttgtttgattagctcttcttgatctgcggtttgagttaatggatgcttattaaaaacaccgacaaatccacacatagtatagcctccataagtgtaattttctaattggaccccctttttatagacgctttgttacgccattggtttcacgctatgtaaaaaataagcatggcagcatctacaaaaagggaaagccgcttaagtaagcggctataaaattattctcctagtgcttctttgcgaagcgcatccgccttgtcagtacgctcccaaggaagatccacatcatgacgtccgaagtggccgtaagcagctgtctgcttatagatcgggcggcgcaggtcaagcattttaataatgccggcaggtctcaggtcgaagttattccgtacgacttcgatcagtttttcttcagaagcttttcctgtatcaaatgtattgatggaaatagaaacaggctgtgccacgccgattgcgtatgcaagctgcacttcacaagaatcagcaagacctgctgccacgatgtttttcgctacgtatctcgcagcgtatgccgcagaacggtctaccttcgtcgcatccttaccggagaatgcgccgccgccgtggcgtgcatatccgccgtatgtgtcgacgatgattttacggccggtcagacccgcatcaccttgaggtccgccgattacgaaacgtcccgtagggttgatgaagtattttgtttcttcatcgatcagttcctcaggcacgacagggttaatgacatgctctttcagattgcgctgaatctgctcaagcgtaatttccgggtggtgctgagttgaaataacgatcgcgtcgatgcggaccggcttgttgttttcatcatattcaacggtaacttgcgttttgccgtcagggcgaaggtacggaagaatgtcttctttgcggacttcgctcaaacggcgggctagtttatgcgccaaagagatcggaagcggcataagctctttcgtttcgttacacgcataaccgaacatcaggccttggtctcccgctccgattgcttcgatttcagcatcgctcattgtgccttcacgcgcttcaagtgcctgatcgacacccattgcgatatccgcagactgttcatcaattgatgttaaaacagcgcaagtctccgcatcaaatccgtatttggcgcgtgtgtagccgatttctttaatcgtttcacggactgttttcggaatgtcaacgtatgttgacgtagtaatctctccgcttaccagcacaagtcctgtcgttacagatgtttcgcaggccacgcgcgcgttcgggtcattttttaaaatctcatctaagatactgtcagaaatttggtcacagattttgtccggatgaccctcagtaacagattcagatgtaaatagtcgacggtttttactcattcacttttcctcctgaaaaaagatcttttgcaagaccttctcatatgatacggaactcgctccctcttaatacaatgtcatactatatcagagaatgttaattggcatattttatgaaataaaaaaaccttttccactcgaggaaagggtttggtctgtgtgcctttcactcttatcgctcaaggaaaatattaaaccttgcatcaggttagcaccttggtttcccacagtgttttcacctgcttttttacagagaaaccggttgctgggcttcatcgggcctgtccctccgccagctcgggataagagtatccgctcaatgaaatatcttatcgtaaaagggcggaaagtgtcaatatgaattaaagcgattgcgcgcctttatttcgggaagcaatggaaaaacacaaacaaaaaaccgtaaatagtatagactattttcagatatatgttatactaattccacattcagcgaaatacaaataaaccggcaaaggaaggtttttatgaaattagttgatttaaccgcagatcttcaagcattacttgcaagtccgaatgtgcatcataatttatcggctccaaaacttaccgaaaaagtgatcagccgaaatgaaggaacgctgacatcaacgggcgccgtacgcgccactaccggcgcatatacaggccggtcacctaaagataaatttatcgtccgtgaacaaagcacagaaaatcaaattgattggggcgcggtgaatcagcccatttctgaagaggcgtttgaaaagctgtacgccaaagtcgtcagctacttaaaacagcgggatgaactgtttgtgtttgaaggattcgcgggagcggatgaaaaatacagactgccgattacggtcgtaaatgaatttgcgtggcacaatttattcgcgcgccagctgtttatcagaccggaaacggatgaaagagacccgcaagcgcagcctttcaccattctctcagctccgcattttaaagcagacccggagacggacggcacgcattcggaaacatttatcattgtctctttcgaaaagcgcgtcattttaatcggcggcaccgaatacgccggagaaatgaaaaaatcaatattctccattatgaacttcctgcttccgcagcagaatatactgccgatgcactgctcagccaacgtcggtgaaaaaggcgatgtcgccctgtttttcggcctttccggcacagggaaaacgacgctttcagccgatgcggaccgcaaactgatcggagatgacgagcacggctggtcagattccggcgttttcaacattgaaggcggatgttacgctaaatgtatcaatctgagcgaggaaaaagaaccgcagatttttcgtgcgatccgcttcgggtctgttcttgagaatgtcgtgcttgatgaaaaaacgggtgaagcggattacgacaattccttctacacggaaaacacaagagccgcatatccgattgagatgatcggcaatatcgtgcagcctagcattgccggccatccgcaggcgatcgtctttctaacggcggacgcattcggcgtgcttcctccgatcagcaaactgacgaaggaacaggcgatgtatcacttcttaagcggatacaccagtaaactcgcgggaaccgaacgcggcgtgacatctccgcaaacgactttctcgacgtgcttcggttcaccgttccttccgcttccggcgcatgtatatgccgaaatgctcgggcataaaatcgacgaacacggcgttcaagtcttcctggtcaacacaggctggaccggcggagggtacggagtcggagaacggatgaaactttcgtatacaagagcgatggtcaaagccgctattgacggcagactgaaccagactgacatgacggcagacagcattttcggcctgcacagtcccgttcatgttccgggcgtgccggatgaagttcttcagcctgaaaacacatggagcgataaacaagcatacaacgaaaaagcgctgtttttagccaatgagtttaaagaaaactttaaaaagttttcccatgcagactcgattgccaaaaccggcggacctctcgtgtaatcaaaaaagccaagggcgtttatgccctcggcttttgttttttcagtttgtcgaatgaagcgaagtgagtctgtatgtaatgcttgtccggccgttcgcccattcgagcttttggacctcgccggtgccggatttctctccggttttcgttttgcgcacgtccatcggaatatcaagaggatagacgcggtagccctctttctccaataaaaagatattttcctctatccgtttttcattgccttttgtcacaatcatggtattaaattcaacaggcattcccaaaatgaaaatcccctttcattctcttattctttattatcatatcataaatcaggcatcttaccgtgtcttcatccattccgccagccgccggacaatgcgtctgttttcctgcggcggaaaataatgcgtaaaaccgctgtaataccaagtttccaccggtttccccgcctctttcagcttgtcctcgatcatccgggcgtgttcgatcgaaacattttcatcattctctccatggatgagcagcacaggggcctgaatgcggtctgctttttcaaacggcgaacgccatctgtattcatccggcacctttttcggcgtgccgccgattacccgcttcatcatccgccgcatatccttccgctcttcataagtcagcaccatatcgctcacaccgccccatgaaacgagtgaagccgcttgatgccccatttcaatcgcggtcaaaagccccatgattccgccccgggaaaaaccgaaaatatgcacccgcccttccctgacgttcggatgctcccgaagcaggcggaaagcggaaaacgcgtcctctctgtcctctcccgcaaaatcttcatttccctcgccgccctggttgcctctgtaataaggcgcaaacacgacaaagccttgggaagcgaattgaacgattctcccggggcgtaccatgccgacattttttatgccgccgcgcaaatataaaaaaccgtcatatgttcccggcgccgcaggctcggcaaggagcccctttaccttcagcccttctgactcatagcataccgcaaagaggctgacatgcggactcggagacgggaaccttttcttttctaccagcaaaacaatgcgcctccttatatcatcagtttttttattctttcccaacgtgaatatgggcactcacacattttttatacccatcatacgatatgtaaagcagaaaaggttattttaacgcttaaaacaaggaggttacaccgtgaacaaatggctcaaagcgggctgcgtttttgtcatatgcgcctttttcctgctcattcttccggcttgcagacaggaagaaagtctgacgaaggtaaaggtggcggaagtcacacactccatcttctatacgcctctgtatgtcgctgaagcaaaaggtttctttaaaaaagaagggctccaagtgtcacttcaaacaacatggggcggagacaaaacgatgacatcgcttttgtcaaacgggtcagacatcgcgctggtcggttctgaaacatccatttacgtggaggcgcagggagcaaaagatccggtcatcaatttcgcgcagctgacgcagacggacggcacatttctcgtgtcgcggaaggatgagaaatcattcaaatggaacgatttaaaaggaaaaacatttctcggccagcgaaaaggcggcatgccccaaatggccggtgagtacgtcctgaaaaagaatcacatagagccgaaaaaagacattaacctcgttcaaaacattgatttcgccaatatttccaacgcattcgcatccggaacgggtgattatgtgcagctgtttgaaccgacggcatcccaatttgaaaaagaaggcatcggtcatatcgtcgcatccttcggagaagcttccggccaagtgccatacacaacctttatggcaaaagaaagttatttgaaaaacaatgaaaagacggcggaaaaattcacccgcgccatctatcgcgcccagcaatgggtggaaagccatccggccaaagacatcgcaaaaacgattcagaaggaatttgccgatacagacccggccattatcgaaacatcgatagagcgctataaaaaacaaaagtcattctctgcagacccagttctgcaaaaggatgaatgggaactgcttcaatctattatggatgaagccggagagctcccgaaacacattccgtacagcaaactcgtcaacacaaaaatcgccaaaaaagtcacctcagaacaataggaggaacatgaatgtcttttttacatgtggatcatgtaacacatacttatttctcgctgaaagaaaagacaaccgccgtgaaagatatacattttcagattgaaaaaggggatttcatctcctttctcgggccgagcggatgcggaaaaacaacactcctgtccattctggccggccttatcacccctgcgcaaggccgggtgctgatcgaaggaagcgtgccgaaccataaagaacaccaaatcggttatatgcttcagcaggattatttatttccttggaaatcaattgaggaaaacgtgctgctcggtttacacatttcaaaaacattaacagaagaaaaaagagctgaagttctcagccttctgcctaagctcggattaatcggcgttgaaaagaaatatccgaaagagctctcaggcggaatgcggcagcgggcggcacttgccagaactcttgcgccggaccctggactgctgctccttgatgaaccgttttccgcgctggactttcaaacgaagctttctttggaaaaccttgtcttcagaacattaaaggattttcaaaaaaccgctgtgctcgtcacccacgatatcggtgaagccatcgccatgagcgatacgatctatttattttcgaatcagccgggcaccatccaccaaatattcaccgtgcctaaggagctcgcggctttagatccgtttgacgcgcgtcaggatccggcctttcagccgctgtttcaaaccatatggaaggagctgaattcccttgaaaaacagcagcggcacgattgaagagcttcatcagcagtttaagaaaagacaccaaaaagaaaagctccggatccgtgcgtatcaggccgccattttcatcgtattttttgccgggtgggaaatatcgagcagggcgggctggatcgatccgttaatcttcagctcaccctccgccgtttgcaggcttttagttgaaaagattgcggacggatcccttgcggcgcacatcggcgtaaccttaggagaaaccgttctcggctttttgctcggcacacttctcggcacatgcctcgccgctctgttatggtggtcaaaccggctcgcccgggttttagacccgtacctcgtcattttaaacgcgatgccgaaggtcgcactcggaccgattctcatcgtggcactcggaccgaatttcacaagcattgtcgccatgggagcagtcatcagtgtcattatcacgacaatcgtcgtctttacggcttttcaggaagtggatgaaaactatattaaggtgatgaaaaccttcggagcgaaaagaagcatcatgtttaaagaagtcattctgccggcatgcgcccccgcgattatttccgcgcttaaagtgaacgtcggtttatcctgggtcggtgtcatcgtcggcgagtttctcgtttccgaaaaaggtctgggctacatgatcatttacggattccaggtcttcaatttcactcttgtattcttaagccttctgatcatcgcgatttttgcgacattgatgtatcagggagtcgaactgttagaaagaaaatggacgaaaggaaaaatataaaaaagacccgtgcgtaagcgccgggtctccgttttttatgattgaaatacgccgtcctctttcagctttttcagactgatcggaagcaccgaatctttcataatgaagctgaattttttatttcgggggagattctccggcagttcgctgaacagcaccggcccctttgtttcaaaatagtcagcctgtttttcaagcttttcaatatcggcaaaataaatattcttcacgattaccttttccctgccgagaactttatactgtccgacgtacttcagatgtcttaccgcggcgccggtttcttctttcacctcgcgcagggccgcttcctccgcacattccatcggctccacttttccgcccggaaattcaaacccccggtcttcgtgctcagtcaaaagccacttatctccatatcggcatatgacccatacatgcttcgggctgtctgaaaaaggctggtgttcaaaggagagctgaacagtattctgataatagtctttaaactcgtacatgtttatccctctaatccgttccttcatatcttccatacatcataccacagttgcatttgttcggaagccctttatcaaaaattcagaggaaaaccatcatacccgctagtatagcctcctttgaagcaaatgttacggtttgcgcttgaatttatttttcaaagtatccaataggtcgacgagcacctgcggaaccgggatgcccagcgagcttgccgttatcacgatctgaaccgattcgtataagatataaaacataatagccaaattacggatagcgccttctgaatgaagcagctgatcaaaaaaatggcaaactgagactaatgccagggtcacgatttttttgaccagccgcgcaaaaagctttcttgcgctcagctgctgcaaaagagattcttttaagcttgtactgataaactcaatcgccatgaccgatagcaaaatcagaaacgaatactgaaaaccgccaaagaaaaaccccgctgccgacacgatcactgcaaaaaacgaaaagatgccaaagtctttgcccacttgatccaacatcctttcacagaaacggccttacattattctatgaaaagtgaatggaacggactggatttttcagaaaaatggacaacacctctcttcggcagccaaataaaagaccgagtgctttatggccccggtcttcccttgttgattatcctagatacgctttcagcatccagttatgtttttcgatattctggtgaatggcaagcagcatatctccggtcgtttcgtctccgacctcatctgcgagatccatgccgcttttcagctcttccgcaatgacagtgaaatcatcataaatgttctgtaccatttgttctgcgctctcattgccttccgcttcttttatagaagcagtcttcaatgattccgtcattgtgccgatcggcttgccgttcaatgccagcagacgttctgccagatcgtcaatatatgtagccgtttcgttatacagctcctcgaacttttcgtgcaatgtgaaaaagtccttccctttgacgtaccaatgatagttatgtaatttcacatacatgaccgtccagtttgcaacttgtttattgaccgcttccaatagtttttctgacatgcctatcttcctcctttgatttactattgatataccctatatatcgtgtgttaaaacataaatttttagcccttgattttacggatggaaaatatgttatgatttgttaaaaaggagggatttcatgctgcttcttctgagcttcggctttcttatcgtgctcgccgtgctgcttttatccatctggtcgactgtaagagcttataacgtaaaacatacgattgacccgccggaggacgcatcaaaaggcttgacggataaaaacaatccttaatgatgatgcgtctgttcctcatggccggaggaatcatcggcagcttcagcatccccgacacgcacttttacagtcggcatattatgctgctgttttgccgttacgtgggattgaacggtatacacaccctcttcatcaaattcagtccgcaggtgatacgcccctttttcctccttggccttgcttgttttgctgctgcctttttttccttctttccatacttcaaacatgacttcatctgcatccgtgacacgcttgccgccgtaaaaaacctccgccttgtattccgttttttcatgcggtgctgccgtttccggtcctgtaagcttgacctcaagcgctttaggctcctcatccgcggcggttttgtccgaattgcccccgcaggaagataatagaaataccataccgcacatacctgccaatacagcccgtttcatcccatcactccttcatgtttgcttctattttagcaaacgcttacacataaggtgtgacattttttagaaatatgtaaaaaagcctttttgcatgtcagcaaaaaggcctgttttttatccgaacactttcagcaaatcttctttatcttgtgacagccagaaacgcatcagccgtttcgcgccttctaaatcatgaagtttcgcctggccgcactgtttttcgttggccgccggaatctccgtaatatcgatggcttctttcagcgtagcgtcaagcaggtctacaatttcttccgctgtcggctcgccgctgacaacaagataatagcctgtctggcagcccatcggtgagatatctatgatgtcgaagtgatcgtatttctcagaatgtgtgcgaatcgtaaacgcaagcaagtgctcaagcgtatgaatcgtatccggcttcatcgcctgtttgttcggctggcagaagcgaatgtcaaacttattcacgacgccgtctgttccgactttatgcactccgcaatgtcttacatacggagccacaaccgcattatggtctagctcaaaactttctactgaaggcataatggcactccctttttttcagaatatgcatccattataacacagttttccgataagaattgtggcggaagcttttcaatctgaaattttttttctatactagcatcagaaaggtggttttttaatgaaaaccataatgattgcgctcatccgcggataccagaagttcatctctccgctgacgccgccgtcatgccgcttttatccgacgtgttcgcagtacggaatcgaagccgtcaagactcacggcgcattaaaaggcggatggctgacactgaagcggattttaaagtgccacccttttcatccgggcggtgttgatcccgtaccggacaaaaaacaaaaacattagtccatatgctggtagccgtcgatcaccagatcaagtttaccggtttcaggatcaatcaccagaccgtgcaccgggacattatcagggaatagcggatggtgtttaatgacgtttacgctgtctgtaacactcgcttctactgaatcaaagcttttcagccattgatcaagatcaacacctgagtgcttcagcatgtcaatccgctctttcggaataccgcggtcgataattttatcaagcatatcctcgctgttgattttgctcatgccgcaatcatggtggccgataacgcagacttcatcagcgtttaattcgtatacggccactaaaaggctgcgcatgatgcttccgaacgggtgggcgacaagcgcgccggcacttttaataattttcacatcgccgtttcgcatgttcatcgcatgcggaagcaattctacaagacgtgtgtccatacaggacaaaatcgccatctttttatccgggaatttagatgtttggtatttttcataatctttgtttttagtgaactgctcattaaattgcatgatatcgtttagaagactcatcttggtgtttcctttctgcttttttattcacaatataacataaggcgggtcatttcgtcactccccgcacgagatgataaagtgctcaataaataagacaaaccctattgggcttgtcttatttccccatattgtattttttgttgaactgttcgactctcccgcctttttcgttgaatttttggcggcccgtataaaacggatgcgtatctgagctgacttccactttaatcagcgggtatgtttttccgtcttcccactctgccgtttcctctgacgttttcgtagaatggcttaaaaagcggtagccgctgttcacatcttgaaaaatcacttggtggttatccggatgaatatcttttttcatggtgatctccctttcttaaatcgtaataattacgttttattctaaaccttaaataggcgcttgtcaatcatatatgccctgatcccttgatttctaaaccctgcacatatatggaatcggaagaataatctaatcgcttcagcaaataatataaccacattacataaaacggtaatttagaaaggcggtttatgatcgtggatgatttagtattagccagaagtctgttcgggacaaccatgggctttcatattatttttgcgacgcttggtgtcggcttgcctctgatgattttaatggccgaattgatttatcaaaaaacaaaagatccgcattatgccattatggcgaaaaggtggacgaaggcgcaggctgttctgctcggcgtggcgataccgaccggaacgatcgcgggtacacagcttgcccttttgtggcccggattcatggaggtcatcggcagggtgatgtcacttccgtttcagattgaaatttatgctttctttatcgaagcgctgtttatgtccatttatgtctacgccgctgaccggctgactccggcgatgcgcatcattgccgttattttcgttttgatcggcgccgcggcatccgccgtcttaatcacaaatgttcacgcatttgaaggaacgccggccggctttaaaattttaaacggcaaaatcactgacgtcgaaccgtgggcagcgttttttaatccaagctttttcaccaccgcgggccatgtcgtactgacggctttcatgaccggtgcatttatcgtcgcgtcagttgcggcttataaaatgctgagaacgagaaaacaggagcaggtataccgctttcaccgaaaagcgctgctgctcgctttaacgatcggcgggatattctctattattgcttctttaaacggtcacgagtcagcccagcttctttacgaataccagcctgagaagcttgcgggcgcagaagggctgtttgaaactagatcacacgctccgcttgcgatcgggggttttactgatgcaaaagaagaaaaagtaaaatgggcgatagaagtgccgtgggctttaagctttttggccgcaaacagctttgataccgtcgtcaaaggattgaacgcgtttccaaaagacgagtggccgcctttattcatccatacactgtttaacggaatggtcggcatcgggatgctgctcattttgtactccatcatcggcatcgtgtggagaaaaattttaaagaaagacagctttccgacttggcttttgattttatttttaaccgcaggaccgctcagtctgatcggaattgaattcgggtggatattcgcttgtacggggcggcagccatgggtgatttaccatctcctgaaaacgtctgatgtcgtcacgacaaccggttcaatcggtttgctgttcatcctgttcacagtggtttacgccattttggcagccgcagtcatttatgtgctgctttactatttccgcaaacatcctgttgaggaggatgtaaaagcggcggaatcctaacaatagaaagggctgaattgaaatggacattaccatggatgctctcattgcgatatcaatcgtatggggattcgtgtttatctacgcggtcatggcaacgatggacttcggagccggcttttggtcgatgatatatttaaataaagaacaaacaaaggcgacaaacatcgccaaccgttatttgtccccgacatgggaagtgaccaacgtctttatcgtcgcgatcgttgtcgccctattcagcttctttccaggggcaaccttcgtgctgggaaccgttttattgatcccgggaagtattattttgctgctcttagccatccgcagcggctttctcgtcttctccaatacggcgaaggaaagaaaaatcatgagatatatctccggaatttcaggcttcattattcccgctgtgctgattttggtccttccggtcacacacggagggtttattgagaagacgggcggagtgtatcacctgaatttggcaaatgtctttacaagccttaatgcgtatgcgtttatcggctttgccattttaagcactttatttttatcttcactgcttctggccgatttttcaaatgttgcggaagaggagcatgcgtaccgcatctacagacggagctctttaataacagggccgctgtcgcttctgtttgccttcttcattatgctgacattacgctctgaagccggctggctgtatacggggatgatgaaagacaagacatggctcattctgtctgtcattacatttatcattgccggcgtggctctgtttttgccgaataagcgcttcggccgcaacctcggcaaaccgagaatcgccatgatcgccattgcgctccaatactttctggcaagctatgcatacggacgggctcatcttccttatatgatttatccggatattacggtcatgtcaggatttacggagccggcaaccttcagggcgctgtttatgacgtatatcgtcgctttcatcattttgttccccgggttttatttcttctggaagctctttatgaaagacagacgttatatccgccaggaggaataacaaaaatcagggcggctcatactaatggcgtaccttttatcttggaggggagccagcatggaccaaaaaattctgtgtgaagtcaataactgttcatattggggcagaggaaacaaatgcacggccgacgctatttatgtggtcagccatacaggcgaaaccgctgaaaaaagtgaagaaacggattgcaaaacctttaaaccgcaagatttataaaagaaaagagctgttttatacagctctttttcatttccgccgcaagcctccctgagccggggaaaaccgcgcggatgagaagcatcgcagaaaggcggttaggcggcaaatataggcggcggcatgcgatacaatcagtatcgcattcatgacaagctcagaattttttatcaagatgtacatgtttgccccagccggaaagcagcacctgtgttgtaaagccgacactgtttgaagaataaaaaaatcatcgcatccgcctattaaaaaaaccggctgatacagccggttcaaacgggggaaggggtgataatgaacagcttcaatataacagcagcgtacaggcagctcaactcgctgaaatgtctttttatcagttgtttgtcgtaaaaacgtccatttgggtgacgtattttctcattatttcctgattgacttcaacacctagtccgggaccgtccgggacagagatgaatccctcttcgatacggatatcgggagtgacaatatcctcctcccagtatcggtctgatgaggaaatatcacccggtatcgtaaattgcggcagcgaagcaagcgcgactgtctgcgctctcgaaatgccggtttcaaacattccgccgcaccaaaccggcatgtgatgctctctgcataagtcatgtatttttaatgcctctgtcaggcctcctacacgcgccggttttatgttaatgattttacagctcccaagctcaatcgcccgccttgcgtcatcataagagcatatgctttcatcaaggcataccgcggttcttaagtgtttctgcagatggcggtgatcgacaatatcatctgcctgaagcggctgttctatcatcatgagctggaattcatccaactctttcagcctgctgatgtctttcagttcataagccgagttggcatccgccatcagcggcacgttcggaaaacggctgcggatggctctgaccagatcaacgtcatggccgggctgaatttttatttttatacgttgataaccttcttttacgtattgctcaatttcccggagcatctcatcagccgaagccagacccaccgccacgccggcgggcactttatctcttttgccccctaaggcttctgcgagagatatcccctttttcttggcatatagatcccacacggctgattcaagccccgcttttgccatgcggtttcctttgaaacgcgcgagactgtcaggcacttctgacggatggaaaaactcgcggcctacgacatttgggatgaaaaaatctctcagcatatgcgcgcatgtctgaatcgtttcttctgtataccacggagaagaaaacgccgatacctccccccagccggttctcccggtttcatcgatcgcttccacgatcaaaaatttacgatcctgcagcgtttcaatacttgttttaaacggttttttcagcctcatacttacatgataaagggtgattttttcaatcttaatcatgacaattctcctttacgaagctcattcagccgatgcctcatcagtttattggacgcgttccgcgggagcccgtcaaccttgaaaaaagcagccggtattttatatttagcaagccgctcacggcaaaaggcggtcagctcctcagaattgacagaagaagtcagcacgagaaaagcatgcggcactttcccccacttcggatcttcggctcccgaaacaccggcctccgctacagccggatgggcaagcagcgccgcttccacttctgcggggtagatgttctctccgcctgaaatgatgaggtccgaccgcctgtccagcacgtataaaaacccttcatcatccaaatagccaagatcgcccgttttaaaccatccattatgaaaagcggcctggttcgcgtcgtcacgatgataataccctttcattacattcgggcctttcaccgtaatttcaccatgttcaaacggcgcacaagggtttccgtctttttcaattctaatttcgcatgaaaacagcggtttaccggccgagccgagcttgtccatgctgaattccggagaaagtgtgacaatctgtgagcaggtttcagtcaagccgtaagattggaataccggaaattgtttcctgcggcattcttcaaggagcggcagcggtgccggacccccgccaagcagaatgcagcgcagtgattcaggacattgttcagtttccgcaagcaggcccgagagcatggtctgcaccgctgaaatgatcgtgacctgatgggagctgatgctgtccagcacatcagtgacagagaatttttgatgaagcacgacgggcatgccgtaaatgaccgacttaaacagcgcagacagaccgctgatatgaaacagcggcagcgcaataagccagcggtcccgctccgtgacccccagattcagcgcagacgatacagcgctggaataatgattaccgaaagtctgctgcacccctttcggccttcctgttgttcctgacgtatacataagagtcgccgtatcatcaagcgttacataagcttccggctccatgtcacccgcctcttcagcctgcagctcgtccacatctgcggtggcgaccgcagattcatattcttcgcggcaaaaaccgtcctccgttaataaaagctttgcctgtgaatcttcgagctgaaacaaccgttcctgttttgagagcttcgtattcaacagcacagcttccgcccctaataagaagcaggcgtgaacggcataaaccatttccggtctgttagaaagcaaaatcgcggcgcggtctccttttttaagcgaacagtatttggacagccgcgcggccatttgtttagaagcatgatataattctctgaatgtcatctgtttgttttcaaatatgagagcgattctctccggtgtcagctgagccctttgaatgagccaattcggctgttctgtcagcatgttatcatctccgaggtaaaagtactgtttttgaaaagaaaacagcttggaccagagcggctcaagctgtttcgtagtgtcatctgatcacggaaaacgagggaattgaccgaaatcgggactgcgtttctctttaaaggaatcacggccttctttcgcttcgtcagtcgtgtaataaagaagcgttgcatctcctgcaaattgctgaattccggcgaggccgtctgtatcagcgttaaatgccgctttaaggaaacgaagggctgtagggcttttctcaagcatttcttcacaccatttaattgtttcctcttcaagtttctctaatgggacaaccgtattgacaagccccatgtcgagcgcttcctgcgcgttgtattgacggcacaggtaccagatttcacgggctttcttatgtccgacgatacgcgccaggtaacctgagccgtaaccggcatcaaagcttcccactttcgggccggtttgaccgaaaatcgcgttatcggccgcaatcgttaaatcacagacgatatgaagcacatggcctccgccgatggcatagcctgataccatcgctacgaccggtttaggaatcacacggatcaaacgctgaagatcaagcacattcagacgcgggatttgatcgtctccgacatatccgccgtgaccgcggactttttggtctccgcctgaacagaatgctttatctcccgctcccgcaagaacgatgacaccaatattggagtcatcacgcgcacaagcaaacgcgtcaatcatttctgataccgtcttaggagtaaatgcgttatgtacctccgggcggttaattgttatttttgcaataccgttatacgtctcgtacaggatttcatcgtactgacgttcacttttccattctgcagccattgatatgacctccttcatttttgcctgagtccggccgaaaagctattttctttatgctttacaagccgtataaaaactcacttactatcttaccaaaaattcgcggctgttccacatgtaccgtgtgccccgcctgtttgacaacctctattttacttgatgggagcaggttatgcaccttttgattaatagcgcaaaacttttcatcccattcaccgcatatgagcaggacgggcgccttgatgcggtgtaatgcctcccaccaggaaggctgtgagcctgtccccattccgagcaggcttcctgcaagtccggacggattattcttcagcctgccggcacggatggacgcctttacgctgtccggaagagaaagctgcgtggcaaacaacggaatgctctcccaataatcaacaaacgatgttacaccttcccgcaatataaagtcagcaagcttccggtctgactgaatccgttttttgcgttcctgaagcgtgctgaggcccggggttgtactttccaaaacaagcgctgacacccgatgcggaaatgcctgtgcaaaggaatacgcaagtcttccccccatagaataaccaataagtttcactttgtgaagttttaattgatcaaaaacggcggcaaggtccgcaacctgccggctcgcactataccttgccgcttgcacaggcgcgtctgtctccccgtgacccaggcagtcaatcatcaccaatcgctcgccgggaaacatgccgcgtaaaaacatccatgattctttgctgcccgtaaatccatgcagacaaacaatagcttcacacgattcgtgtccgctatcagcagcacgatagcatacgctgtcggccgttttaactgttacagtttccattcttttttcacttcccgcactgcggcctgcagcagatcgcgatggaattgaactcttgatgtccgatctgttttcagctcgattatatgaagtccgggcttgtccgcctgcggctgatacgcatccttaaatgcttcccatgtctcaggacaagtatacgtcccgccatacagtgcggcggcatgccggaaatcaagacccgtcggcgtaccgaacagttcttcaaaatgagtcttatcagatgcctgcggcaaaaacgagaaaatcccgccgccatcattgtttattaaaataaccgtaagcggaattccaagttttttagccgctaacagcccgtttaaatcatgataaaacgataaatctccaatgacaagcgtgacaggagcttttgtaccttcacacagtcccatagccgaggagacaactccgtcaatgccgttagcgccgcggttggcataaacacggaaggaacgatcttgtttttcaaagaaagtatccacgtcgcggatcggcatgctgttgccgacaaaaatcgaactgccttcagggacaaggtgctgaagctgacgatatacatttccttcaaatgataaatcatccatgctcgcggcctgtaaatgactccggaaccggtcattgacaaattgccatttctcaagccatccggacggccgttttccggtttcagctgaacggaccgcttccaaaaacacagacggatggcaatgaatcatatgcgcgccggcctgggtgggatctctccatcctccgtcttcatcgacgataaactgctcaatggcaggatcgtctctgagccataaaaagagcggtttggaaaccggcatcggaccgaagcggatcacagcgtcagggcgcagcgcctcttttatttcttcatcttttaagaacgagtcataagcatcaataatcagcgtcttatcatgctccccgtttcggaggtttgaaagcggatcagccaaaatcgggaactgaagcacctcggcaagcgcgatgatttgctgcttttctgcttcaccgtgaatttcgccgcagacgatcatacctctttcggtacccgcgagacgctctgtaatatgacagagagagtcttgatcagctgactgaatccctgttgtgactgagacgtgcttcccctttctcattctttcaaaaggtccggctgataaatccggcatcaaaggctctctgagcggcacattgatatggactggccccatcgggcgcttcccggcttcacttacggctctgccggccaatgttctgacatagctcagcatttgaggattttcctcaggcaaagctgagtctgtgaaaaacttaacaaagttaccgaacagaaaatgctggttaatcgcctgaggcgcccccacttcccttaattcatgaggccgatcagcagtcaggacaataagaggcactcttgaataatgagcttcaatcacggccggatagaagttagccgctgccgttcctgacgtacaaatcagcatgaccggacgctggcgggcttttgcaagaccgagtgcgaaaaaacctgcggatcgttcatcaatctgtatatggacttgaatatccgggtgggccgccgccaaaaccgccaggggagttgacctcgatcccgggcaaacaaccgcgtcggtgacacccgatagcgcgaattcatcaataaagcttccgatataatgtgtaatcgggtttgtcaaagcctttcacctcctaaagcagagatcatcggctttagtttaatttgtgtttcttcatattctgattgcggatctgaatcttcaacaatgccgcagcctgcgaaaagccgcgcacttttgccttcaatcagccctgatcggatagccacgacaaattctccgttttccctgccgtccatccagccgatcggagccgcgtaccatccgcgtgtcatcggttcaatatcagcgataacttcaacagctttctgctggggagctcctcccaatgccggagtgggatgcagcttttcaattaaatcaaacagcgaagcggacgttttcagatggcctgtgatcggcgtatatagatgctgaacactttttgttttatataattgcgggcctgcaggctttttcacatcactgcagctcgacaagaaagaatcgtgtatcatcttaaccacaaaatcatgttccgcgagatttttttcgtcatgcagcagctctttgccgagacggtcatcttcttgttgattttctccgcgcttaattgaacctgccagacaggtggacataacgtctttgcctgattttttgatcagccgttccggtgaagcgccgacaaagcatttatctccctgctcaatcgcaaaaacatagcttgtcgtttggtccgtcaaaagcttgcggacaacgctctcagccggaataggcccatcatatgacaaaacgacttcccttgccagcacgactttatcatattgatttgccttcatatcatttgttgctgttttaatggcttcaagccagttttccacatcaagttcttccgcttttgttaaaacaggatattcttcatactcaattgaagaaactgcaaaagcttctgaaaaagatttcagacgtttcagcgtatcttctgcctgattaccgtctgccgcccattgattgacggttaaataatcgccatctgccgtctttgtcagcatgagtgaagggataaagaacagtccttcttcaaacccgttccattcgtctcctctctcttcagcgggattaaatgaaaaaccgccgaataagacagggcctaccgcggtatgcgccgcctcttcttcttcatgaatatgaaaagccgtctttttaaagcgctcccattgttcaaaaacgtcgtgataacgttttccatttttttcattcgattggaacagcgcttctgtgccaagaccgactattgttaattcactaccgggttctgaccaaaaaaatcgtttgcctttatatttttttgctccgtctttgaaaaatgatagagggtctaaagacgcaatacgtcttgaatagctcaataagacagcatggttgacttgtttggctttatgtaatgcatgatctgcttcctctcggaacgtatgctgcaccgttgtcaccatgagacattcctccataatccgttaaatgcttttaatacaatacacctgtgatgaatttgtgtcaaacacacagatttgagcacgacaaaatgcctgcatttcttattataaacctttttgcgcaaatgaataaagaaacaaacttgaattttctttccccactctcggcaatcactgtatccttttacttcctcgtgggaaaatgactatttttatccaccatttttctgcgtaaaaacgttcatactaacagtaagcatcacatagaaacgagggattgatgtgcttacaaacgaacagatcacacacttaaaaaaagaattggaagaagccagagatgatattttaagccgctttaaagaaaatgatcaatttcagttaactgatgaattcccgtatcaatcatccggcgaattgtcttcctatgacaatcatcccggcgatcaggcgaccgaattatacgagcgggaaaaagacctggctctgctcgaccatgaaagggagcaccttcgcgatattgattactctctgaaacaaattgaaaacggcacatacggcacttgtgaagtcagcggcaaggacattccttatgacagactcgaagctctgccgacggctacgacattggcggaatattcctcgcaggatgccgtttccaaagacaggccgattgaagaggaaacaccgttcggacagtttgaatttgatgatgatgaatcaatccgggcggcttacgatagtgaagatgcttatcaggatgttgaggaatacggaaactcagaaacgcctcaggatttagaagatccgccgctcagctatggggatatgacaatgaactcagaagaaaacatcggctatgctgaggattatgaaaactttatcgcgacagatattaccggaaaaaacatttccgtgtatccaagcaaggcacacgaaaaatatgagcaggaactggacgaagaaggaattatgacgacctttggcgaccttcatgctgattaaaaccccggcaggccggggtttttgaatacaaataattggtttgctgcattttcacaccgaaaactcatacacttaatggtgcatgaaccttttgaacggtttaatctttccaagaaagggaactaacgtattgacattgaatgacggagggaacaaatgaaaaagaagtatatcggtgcgattattgtatttatcattacatatgtcttgttttctttagcagggtttctctttcccatcgaccgggaatggtacgacgcgctgcaaaaacctgactggacgccgggcggatcagtgataggcatcatatgggcggttttgtttgcgcttatttcgctctcagcagccttaatatatgcaaagttttcatgtaaagaatccaaagctttttgggtgatgctcctcatcaattatatcgtgaatcaaggattcagctattttcaattcacacagaaaaatttgcttgctgcatctatcgattgcctgcttgtggctgtgacaacactcattctgttgctcattgccggtaaatacagtaaagcttcagcctggcttctggttccttatttattatggagcgcttttgccacatacctgtcttttaccatttacgctatgaacgcataataaaaaaccttgcatactatgcaaggtttttttaatgacccgtacgggattcgaacccgtgttaccgccgtgaaagggcggtgtcttaaccgcttgaccaacgggccttatggcggagaaggagggatttgaaccctcgcgccgcttacgcgacctacacccttagcaggggcgcctcttcagccacttgagtacttctccataatggctccacaggcaggattcgaacctgcgaccgatcggttaacagccgatagctctaccactgagctactgtggaaaaatcatcatggtgggcctgagtggactcgaaccaccgacctcacgcttatcaggcgtgcgctctaaccagctgagctacaggcccatgacaatataaaaatggagcgggtgatgggaatcgaacccacga

SEQ ID NO: 133 - DNA, 35456 bp, Bacillus velezensis FL50S
tttatgtgtattctctttatgattatatatattacctcgtggttttgaggtcttcattttggggtcttcattttgaggtcttgaaaatccagtcctcaaaaagtgatcatcttccccttttttgtcctcatttgtaccctcaaaggatgctttttcctcttctgtgaagggcgttgtcctgattgcgtattcatactcccattttctaccgttcctatacttcttttccatgacgtaacccgcctctattaattccttccaggcgttccgaacgctcgtttctttgttcttgtcaaaacgcttatacaattcagttttgtatatttgccatgtgtcgggataagaacaaacattcaccaagagtcccaacgcttgcaaagatatactactgtcttgcaaagttgttctaggaatcatttcaaacgggttttcttgcttataaactttgacaattccagacataaaaaaatcctccaaaacatattttggcaggaaaaaggggtttaaaaaaggccctatgtaaggtataataaaaccaacaaaaagcgaaaaaataatttttacaccctacggcccgtgctaccaacacgggttttttcctgtttataagtatgatactataaacaaacctcactgacaatatcatcgttcactttcagataacttaaatgacaaactatgcctaaaatacacactggtttggccgatatttgacggaaagtatcctgcgagggtacttataacccccgcaggacaaaaacctctcaggaggcttataatagctttttcatagattaatgaaaatcctcatataatttttcgatggcagaacatatatcatgctgccattcgttgtcttctgtcatggatgctgccaaggataggttttttaaggtcgccaccttcctacacttgttcatgtttgcatccaggcagatttttaattcgctcatttcttcttttgtaagtttccgctgattgctttgaatgttccaaagctccgccattctttgatgtactccccacatgaaaagcaggccccctttcttgttgtttaatatattgtatgctttaagggtacaaaagatgatttaaattccaaaatatatccttaaagggtacatcgagagatgagtttatacggtcaataaactccgataacaggtttgtgaatttataaaaattctcatttttgctttcggaccttccggcaatggaaaaattgtcaaacattgcttggcgctgtccggtgcttatttccaactgaatgctttttccagttctattcctattcgctatgttgtccggatctgttccggctagagttgagttttcagatagtaactcagcagaaaaaccgattttgtttaataatgcgacaagcatttcagccgtttccctgtccgtgccgccgactaaagtatgttcatcgtttgaagaataaccatgtaaggaaatagtcaggtcagacttactcaccatgttaagcgctaggggctcatcgaaattagtgcttgttatatggaggtcaaaggccccagggatcttcaaagactcaaataaataggtcgagtatgaatgacttaattctaaagccagttcgcttgtacctccctctatgccgccgccgtgaggggctaagattaaaacaggcgtagaaatgctatttgcaaaaacacgatagtttgatgatggctcatttgcttccaattcctcaaaactattgtatttatccattgcaaaagcccagaaagagaacataaacgttatcagtagcgacacgagcagaattgataagctgcgcctgctaatggtataatgacttaacttcgctgttatgcggagcaccaggcaaagaagggaaggccgaccaaagcgccccttctttgcccctttaaccttttttggagctttatctattctgtttttgtattgcaatctcaattcaccttcttttcctcattttttgaaaatcctacttgtcatttttccgacggcccggtttcttatccttttgccgtacgtccctttttttatcgcgtttacatcacccaaaaacttcgccaactgatacaagaatgttctgaatttagtcactcagttttcccccttttggattttaatatcttaatcataacgctgttgtcactttttcgcagtcaagaatgggactgtctgctataaaaaattctaagtgcgtttcgccagtttcttcatcgtggattggctcaagctctcctgtaagaataccccgatgattgaattccattgtaccttcgataatatccgcgatttcatcccacacgggccattcggcggcgtaatctaagaatgttggcataacctcgataaaacgattaacaccgatgaaaacgacgcgtgttccttttttggttattacatcatgcctatcttcagttaaacacattttttattcccccttgttgtcttataaccccattatattccctttaagggaacaaatcaatataatttattgaaaaagtatccttaaaggataaaaacaggcaaaaaaaggggatgtaatccatccctcaatatttgtgttgtattaaaaatgaatatatgtagtcgataaaatcaattcgtgttaattggttatggccacgccattcataatatttaacctcgctgagtagatttttcaacgcttcattttctaataattcaattgttaaggaaacctttgcattttctgctttacttaattcttgaggtgaggtgttcaagatgattattctcattagtccgagaagtacgtctattaattcaagccctatttctgtgttcttgggataaaggaaacagtctttagcaacaaatttttcgccacgataaagagaatgagcattcaaagtgttgaggatagtttcttttaatccgattctttcatattctgttgctttatcaataaatatgtctgcttcgaccgcagtttcgctaccgtaaccccttataaggccatatattattcgctcaggaaatttagaataaatggtatgttctcggtgctctttttgaaacaattgctgactattcagaaacccgtgatggtagttgattatatttaattttatgtagtctctgtactcgctgaatgtgttaattaagtcagtaatgttctttttgtaaggaataaacccattatatttgttccaatggatctttatttgctcttctttcaatagctgattaagtttttgaatgtcttcactttggtaaatttttcgaggtatggaaatagcacctaacaaattgggcctttgaccgatcttacctgactcatcaaaaaaaacgtttattttctttgtatggaaggtgctgaataaatgttggctactcaattttaaattccccttttttaagcttgaattcgcacaaaaaacgtgttaccatcataatatcatagtaagatgctttatttttggaaaagctaaatatactctcattcaattctgagtgcgagttttgggagggtgactcattcaattctgattgcgtcgccctcttcgtttatatacacttaattttgagattgtgaaaaactttaacgggataaagtagcagcttcccacaaactacattatgtaaactaaaacagtccatattttataaagaaagcctattagattaggctttctttttttgcataaaaaaagaccctcagaaaagttatctgaggggatatttatccactttgagcgtacgttttattcttatagggtacaaaatccttctttttttcaatctcaaaatttcacaatctcgctttaattattttacttttgcgcctgttatttttcctgcatagatgtttacctttccgaactggtccgtcttgatcgtgtacacgtccgtttggggattcgcaagaatttcgtatttaaggccgccgaattttttcgggcgcaaatagtttatctcgtttcctttgacgggcgctttgtttgtcggatagatgcgccatgagtcggcagatgccggaaggtaaacgtattttttgccgttagatgatgatttagaagaatttgatgatcccgtaagcttcagcacttggccaactttaatcaaattcggattcttgatgccattcagcttttgaagagtagccatgcttatgccttctttttgggcgatttcagataacgtatcccctttcttgacggtgtacgtcgtcctccccgtctttgtttctgttttcgcgggtgaagatgctgctccgctgatattggctttaaatgagtcccaccgatcgagcagcttgtgcgggcattgttttcctgaccagtgtttatgaggtactacgtttgaaagggaaatgccttgctccttcataagctttttaatcaaccattgcgcgttcgctacggctttagcaaaatccccatcgctgttttcgcaaatttcaataccgatagacgttcggtttcctggtccgtttccgtctcccgcgtgccacccgttttcatttaatggaagatgttggtacacttctttttcgtcaactgtaaaatgccaacttgtggccgttcccggattttttacataacgggcgtgcatggccgcgtttgcccctttttccgtgttcgctgtgttatgaactgtgatataagccggattcattgtgtagcctggtctgttattatgtcccactggaataaagtcctttgtaattttcaccatacttcatcttctcctattcttttttaaaaataaaaagagctgctgggttagctagcagcctgatcatctttattggttgttttttcgctttcattttcaatgacgtgcaaacggtctgtgataaattttggaatcttgacgccgatctgtgcaaggttctctgtaatggaaagcccctcattggcgatataaaaaagaacggttccaaatgtcaggacgccgttcaaattaagaatggtatctacaatgtttgccacaatgatcacaagaaagttgagcatttttcggacgtaaccaaaccaagcacttcggcttcgtagactcttaaatttccatgccttaattacgcctgtcaggacatcaataatgctgaagactagcagtaaatcaaggtacttcacaccgccaaacaggtaaattctcgctaaatctaatgtttcaaaattattaatcacaattgtatcctccattttttgttatcacctccttagaggcaaaataaaaaaagccgcctttttgccgcttttgttgtgaaattattctgctgtggtgtttgctgaattcccgaaattatccatgtcggcttctaatttttttatataattctttagtttttttattgtctcttcctgtttgctcattttctccgcctgctttttagccatgaattgttctgtcataagcatgtcttcagccaagacccatttttgctgatattttgctgctttttcttcgaaaatggccgccctctcttcggcgtcagtttccttcacatcttgtttaaattcctgcatttttcaatctcccttcaatgtccgtgacattttctttgaggtttttaacgatcgggattaataacgtcaaaagcctatcatacataaggccttcgatctcccttttaccgctttcgtcagcctcaccataactcacaaattcttttaatcccgctgcttccacatcttcagcgataagcccaggaattcttgtgatataaggcttgtctccttcgtctacctcaccgttttcagtagccaaaacttcagcataagactccactgcgtttttgtcataccaggttttgggtattagatcgagcaccttttcatatttgtcagccggaaactcttttatattaactttatatttactggcggacgtaacgcgaccaagcgttccatatgatgtaacatagacgtttgccgcgtttgagtaggtacggttatatattgcattcgaataaaaacgcgggccggacccatcagaagtcaggttaatatcccccccgtttttcccgccgtacaaactaagaccggacagaatcccctcagtcatgatctgcgcgtgttttgtggcctctcccatcagcacccttaatgtccctttgccgtcgcttaaatcttcagtaagggatagcgccccgcctgtgagtgttaaatttcttgttccaatgtacaaagatttatttgttatagattggatcgctaacatattagcgtttacaccaaaatatcccattgattttgaacctttgaaaaattcaagtgccgggccggatctgtcgcttgagctacttattcttaattctgtgttgtcataactggatgtagcagacaacataccggattgaatagttatccgtgtggaatcgccagtgatcgaaccgccatccgttattacttttccttcagtaacctgaaaaagactaaacttggtattgtcttccctgtcttttcttctcatatagatttcagatgctgttaaatagctgacattgtacgggttaggatcttcaaaaaccattttacttcccgttattgttgctgcattaacggctataccatttaatatgccaactttgattttatcagcagaaagagtccctattttagagtttgttactgatagatcttctaagtgatttgttccgattcggacggttcgtgccgaaaattcatctgtatagtcacttgctgtgccgtgataatttactgtccttattcggtaataccaaacattatcaactccggccttatcatgaatccatcccccctctttccctttccataaaacagaggcttcggaaggtgtaaaccccttcacctgtgacccatgaacttcataggccgcaatatatgaagaagagtcaaaagtccatgaaagcgaaacacttgaaaataacccttcgattgttacattcttagggattggaggctttatatccggaaagctgccgtccgtcacttttgtatctctgtttatgtttttaagtgattcctcaatttcatcaatgcgtttgtctgactcatacacatctaaaaattggcccatttctactttccttgtttcgtccggattggaaatgtcatattcaagggcaatgatacgggactgaaattctattgaatcaacttgcgttcgatctatggctattcttgtatctccgagtgaaactttatcggttgggatgacatcaagcgtgtaattcccctccggttttgaagcgacatttaccaattgttcataggttttttttagtaattcttcgggatctgtaatgttttcatcttgccattggccgaacgtattaataattgatccgtccgaattctgtaaaccatacttggacttggcttcgggaaattcaacccatttttgccctttgggtttatttacgggatcgcctgcagatacagaccatactacatctgcaaaatcaatgtatcgggaattcccgccgttctctgtttctatgctgccgccccaaccatataaagcagaaacagggtaagtcatttctgtatagtgaatactttctacgttatatccgacctcaaaacgatccccttcatccacaccgcgccgatcaactatattaacgactctctcattaatcttgttcgtttcttcatcaaatgagacagtgaaacgcaattcgccgccccatgtatcaataattttcgaaatggcttcataagcgctaatatgataaaaattagttgattgtaggccaagttgcgccgtgacatttcctgtccatcttgttttttctaaaactctatctaacgcatattgctgtgtggcatcctgcggacgtatatcctcgataatagcctctagcagctccatttctgcaggctcacattgaactattttttcagggccttccgctccgttgcttttgtctatttctctgatcttaaaaagacgaaaaaagccgtcttcatctttaaataggacttgatttaaccccgttacatgcctgctgtcatcatgggaagcatcacatgtaaatgaaaaagatgacccttggttcaattcctctctgaatgtggcagaatgaaaattacaagctccttccgcatcagtcgataaaatagccaagggttgatcacccttgtctaaaatccacatatcggccatgacaacccccgcccttcatagatatttgttaatcactcgcatagtgcttgagtgagttgatctgattttcattttcttttttggtgggattttgaaaaactcagatttgatcaatattgctgtgtttctcttggtatggttgactgtagcaagtctttttgagaagtcaattacgagcttgtcatcttttacgaaattgtatttcagatatacccctgcttgtaagacttcagcttcatttagaagctccacattgaattcgtttgtactgctttcgaaagtatattcgataatcggataggtcggggcgctcccggcactcgaaattgttgtaatacctgttgacaatgaaaacactgattcttttccgtgtttataaggatcggggcagatgaatgtgattgttccttttccgtatttaaaaacatcatccaattgaccttccccatcaataaccgcaaaatatgttctgtcaggttcatcagaaaagataaggggtttagcttcatcggtcacaagccattccgcgacttcttcttttgccttttccatgtcgtcaacgccttttattacaacggaaacgcttaaaggacgggcttttactttcttttgcttcggatatgcaccaggacgcccagggatttcaaccatatcccattctatcggggcccacatcggccgttctgtgtctactgttgcatgaaaaaagggttttgatattccattaaattttattgtcatttgtaacgccgcctatctcggtaagattggcgctgctgcgcttttgtcatgtccttttctgttgctgttgcaaatctttgactatttaaaactaaatcagtttgaattgttggtattttgatctctagtggacgttcaaaaatcgacttcgctaatgttcgcacggcttcggccatacctgaatcatttgatttttgttccccgccccatgcaggcatactcaaaacatcggttgaaaaatctttgaaacttggaatttgaggcgtggccgccgccgccaatttatcagcagcatttaaaacatccttttcactatctcccaggccaatttctatcccttcgcctgtccacttaccaactttaatcattacttttgaaggtgaagcaatgtgtaaggtttttttgatttttttagtaacaccgtttgccacatcttttgcctttttgaataatgatccggccattgaactgataccctttattaagccattaataatgtcttttcctacctgtagcaaatcaatacttttgaagaatcctgtgaccttttcccatatgctttttactttgctgaatacagaccccatcttgtctccgacagatccaaccataccttggaatttgtctttaacagtctgccaaatccgccccaagatagaagaaaagaattcctttacggaattccaaacgcttgtcactttggttttggctgcagtcattttttcgctgacggaagtgacaatgccttgaaatttatctttgacccaaccccaaatttttccgagggcttccgagaacacttttttaatgtctccccacatcttacctattgggctcaaaagctttgatgctaatcctgtgaagaacttcaagagtttccctatcccgaataactgaacccaattccaaatgagctcaagcgcgccggaaatgatttttttaacggcttcccatagtcccttccaatcgccagtgaaaagggccgcgaatgcttccacaattcccatgattatctttaaagcgccgtcgatgactcctttaatgttttcccataccgatactattattgattctattaaaggccatgcccatttaaaaagcgtaacaatcgcgtttataattggcgtgataaatgctgatatggcattccaaatattcatgaaagcttcctttaatttcggccaaatttccatccaccaactgcgtacttcttcaaatttttgcataataaaatcacgtatggcctggacaacgggctgcaaatacgtccaaattgctccccagatttcctgagctttttggctgattgtttcccaattttgccacagaagaacgccaaccgctaccagggcagatattgcagcgacaatgggtaaaatcggaactgaaagccctgcaaataaaggaataagggccgaaacggagcttactaaagatcctaatatcacaagcaaagggccgacggccgccagtaacgcccctaagcctacaactacgtattgcatggtcggagatagtgaagaaaaggcgttagtaaggaaagagattgcgtttgtaatagtcggcaacgcattgcttgcaagatccagtagcacatttcccacgggttctaatgctaaaagcaattgacgccaaacggctgtgaatcgttttgagaatgattcttcggcattttgcgtcattttatccatcgttcctgaaacatcaccgattttcccattaatgccgcccagggcatacatcgcatcagattcgaggtcttcccattttgtcacttttgttatcgtaaaggctttttatcctctacttcttacagtttcctgtaagctcagcatacattttcaatcattcaatgattgtcggacactcgtgcctggattatattctgtgatatacaggttcaccaggtatgcgttacgatgcctaaagctcgttacctctttaggttatctcggtattaccctatgaattctattgaaattcacttaggcttcaccgatattgcccgattttaatacggcacaaagataccttctaccgtataaagcaacgccgatattattcgcctctacttggtcatccatgccctttaattcgcctaaaacagcgtttgatacgtctttaacagtcccttttcctgaaagaaaatccttccacactttttgtgtctttccggatagttgtcccattgcttcactagttgattttgatccgtcttttactcttatctgaaattctttcataacgtcattaatataatcgaggttatagacgcccgccttgctaccttttacaagtaactgaaagtattcatcggccgaaaagcccattttcccgaataaaggcgcgtattcgctcaggttatcaaacatttcgttcgagaaattcaagccgttttgagcgccgtaggccatcaagtcaaaagcttttgcggaatcgactccaaatcctttcattacgttgctgcctgccctggtgacttcgttcacatcagcgtcaaacgtctcggccaaaaccattgcggattttgtaaccttttctaattgttcatcatttaatccctggatgttttggcgggtttgaataagagagtcggaaacctcttccaaactctccccaaatcctgatttatagatgtttttcgccgagtttgtaagctgcttcgcctttgcgtctgtcaggcctaaactgttttgtatttttgtttgagacttcccaatgtctaaagccgccgcgattcctgccgctcccgctgcagccatagggacagttagatatttacttaaagattcccctgtgcttttcatcttgtcgccaacttgcgaaaatttcttttgaagactggcaacgcctctatttgcgccggatggatcaaaaatcgaatctataactattcttccatctgacaaattaacgccctcctttattccgcaatgctgccgctaagtcgttcatttttcggtcaagcgcttcaacctttttcttaatccttgcttcgttttgcggtttttcttttagggcgtacaagcgttttaacttttctaatcgcctgcgctcttctttgtcttttggtaactcgcgcattcgtatatttacgacttcgcggaattttgttttttcgctcaaaccgttcaatagggctttaaactttttccaatgtagcttcccttgttgttcaattagatcaatattgtaatcaaacaaaaaagacgcgtagatgtagtccgcgtcttgggtaaaatcataatatggttcatcggaatggctataatcttcgatctcgtcggaattctccgaggatttttctgtcctttccgcaattaggtagtcaaagactgcgtttgcaaatgtgactttctctgagagacgcagaccccttatatctgccggatcagcgacaaacatttcagccaacatttcccatttctctgcatcggaaaagtagtcatcttccaataattcgaaggcccttaacacaacgtcgaaagatagctttacttttatatgctgcccttcaaatgtgattatgtctttaaagctgtcagttaacttcataaaggtatcactttctattcacataggatgcgcgcttttctgctttgaccttgcttgctttatcctccaagaactctcccacggcttcgatgacattatataggtttcgcatggatttcccgcaggcttcataaattggatgaaaagatccctggccgaaaaatgtgtccattatttcttctgcttcttttaatgcctttgccgtcatttcgtcctgctctgcttctgtcatttcgtcaaattttttgttggtagcatccacggaagaccgataaaacgctctcattctccgtaaatatcttcccaggctttcatcatcataagcaagcctatatactttcccgcctatttcaaattcttgtacagtttcttctaaattaaccttgattactgtcattttttcatccccttataaaaaagagcgttagcagccgctaacactctatcttttttgttattcttttggtgctgtgaagtagatccagttactctgttttgactctccgccttcgccaacggccgttacaaaaaaattataggctgttcctggcgttaaataagtagtgctccaactcggattacttacctcggctattttcacactaaatctgtaaacacggtatttctgagcgcccgaaacagtatcccatgttaatttaactgatttgttcttcaagtcctgatactgtaagttttccggcgcttttggtggcgtgacgaattctaccgcttttgatttcaatgactctccgccatcatttacggccgaaaccctgacagtataatgcgttgcgcctgcagtagatagaacgtaagatgtttccgttgctttgatcggatctgcaagcccgctgatataaattagatagtaatttgcccgctctgcagcatcccaagcaagtttagctttgtcgtctgttatgctagatactgaaacgtttgcgggcgcgtcagggcgtttctttttgtgttctcgttacaatctcagactttggagattcaccatgagaattaacggccgtgacgtttattgtgagttgtgtgtctgaggtcagctcattcgctgtatattttgtttctgtgacttcctgtgtgaatttctgatctgcacctctatatattttgtatgattccgccccttctacggcatcccattccactgtaacggtattggctgtagctgtgtaccgtagatttcggggcgcattagggcgtatctgatcctgttgtttcttcgggtgtaccattgaaatgaatttccacactcacttcaccttttccggcagcttcaccgcttggccctccggtaacggcgacagtgatcggcccttctaatgttgtgtcgtccggctgctcccatctcattctagtttcccgctcatttccgatcttaataaatttcgaaaagatccaatcttgagccggatcaccataataacggtggccctcaaacgcaactgttaactgaccgcccatgactgtacttgtaccaaggccgccgccatctaaataattatcctgcgcgatattttcattcatctgcggatcaaaggaattaaatccttttgctagtcttgtccatgttggcttttctgcttcaggcgttgtatcaataaaaaatttgtgtgacgactggattaataggccttctttttgattttgtgccatttaattcactccttattttaaataaatttctgcttgaaacatggccgtatatatagccccttttggggtcgtctcgacgatattaggagatgtatacatattgcatgtcacgaactcaaaagacccgtcacggctaacgatagccccatttattaatcggtctaaatggtctgatatttgctgacacgttttatatgatttctcctggcttcgatggcgcactaatatctgaaatgggaatgtatatcctctctccatggccatgttttttttggacggcggaccaggtatggccaatatagaaatgtcattgtccttcactaatccgccgacacttaaaggattttgaaaaagcgaaatgttgttttcgatatactctttcatccgatcaaaaaaatccatctgcatcacctatatagatctatttctcaactcttcaagcaaggttaaccaacgtcggagaaagagagattttgccgcttcaaaccataacccgcgggcgttgggattcctgtcttttgagaaattatactgaggattataataaagctttttggcgtaaggcgtgtcccaaatcagcttacctttctcaaaatctgaacttcgctgagaactacgaatcagatttgatgtatcctggggcgcgtaataattagcgtctttcaggacttcagaagagagtaagaattgtccttccctgttaaattgatttatcctgtgcgaaacatttcccatttcgatccgaatattcagtctcattttatttccacctcgtaatgatggggagtttttggattttcatcatataaggatctgacccgctgaatttcatacttgcgcccttcaaatgttacgatggacttctcttccggccgcttaaacggttttgaatttaaacgatcaataaagataatagcctcaccctctatatcatttcgggcgttacttctcataactgctgttacgggctctactctgacattttcaatagtcagggaaggcacaaacccgtcaccccatccattagattgatcactatattcctcataatcaattgtatggaccaggagattaataggtattggtttagccatgaacggacaccccacgatataacaggcccgtatgagctaaataagaaagaacagaagggctgacacgggccgcctgattcccttcacttccgttcccgcctttgctgtagctaaatgagccaacacttacactatccatttcatctgatccggcgttaattgccgcgtctccgcccttcattacataaaactcaacttgcgccgccgtcgctttcataatcaaatcttgaattaaaggggggaatttctccaatttctgtccataaagcttgtagtttgtaacttggtcgataatgtccgtggcccggtttatatatttttctaattcagaagaatcaggggccgcagcccctatatagacattgttgtaatagtccggagtgatataaggcatgttcacccctcttttctattcctttttgctgtcttttttggcttttaactctttctgagccttttcaagagctttttgtgatgctttcaattcttcttcaagcgctgcgatcttgtccaacgctttattgtgctcactgactggcactgtgcggccgcccgtggctcttttcaggatatttccggtttcgtcgatctgatcatatccgtcccttagatagccgcttacgcgttcatctgaaacggtcaagacacggtttagctttttcactcttgccatcataatccctccttattctgccgctgcttgtgttttggttacgatctctgacatttgagattctccaccagggccaacggctgttacattaacagtcaattgtgtatctgcacttaatccggtgattgtgtgtgtcggttttgtcacgctcttatccaggcgtttgtcagcacctctgtatacgttgtatgatgtcgccccgtctaccgcatcccatttcacagtaacgctgtctgctgtcgccgtgtacgatagatttcggggcgcattagggcgtatcaggttttgaaacgttaaacaccatgccagggactctccgttcaatagcaaatacatcccagtatttccgctcaaagtacaggtatttcccgcctgttttcgcgctcggttcatcaactgatacaaattcatagcgctgcggagaaagcatagattcaggatgaataagaatcatattaatttgtactgctgatttatcgactaccgccccttgtgtgaagtcataaactgttttcattcgtgcagaagggacaggttttacggtgacttcatccagtgaacgaatgccgcggctgatattgccgttattgtttgttacagatagagaacgtgaaattttgtcagcgtttttaagatccgtataaacaggagcagaaacatataaaatgcggccttccaacggtacttcggcctcgtccatttgcagcatcaattcatcaaagacgccaagagcattactttgatctatttttgttgtttcaggtttgccgccgtattgttgaaactcagaatatagctttgaggccatgtacttatccatttccgggatcttttgctcgtcattaaaggtctttgtaatattcgcgatgctgacggccatgtttgtttcgtcaatatctaccgggtcaaccagggtacggaattcacggtcatgggcaagcgttttagtttcccaactattgtccacctgacgtgaaaatgtgccgatctcattacggttgtaatcggtcatccccgttacatcaatgcgtgggatttgaattgtttttgcatttatccatttaatacgtgtattgtttggtgtgttgtaaagctctgaaaagtataatccttgtgcgaatcgctgttgtaatccttgtgcgtaaagctcggcatagtttgtgtttggcatatttgttacctcctattttttaaacgcggccgtccaagcgtctaactcggtcggtgattgcttttgatgttggccgtttgtgaaatgcggcttttctgtttcctcctgatcctgctctgcaaaatgcggatatttttcaacaaccttttgaatggctgcggccatgtccgtatcatcagacaaaagattttgagccaatgtgaccacatctgtgaccgaatcagcttttacgcctgctttcattgctgaaatctgcgctttaagcgtttcgttttcgcttgtgagtgtttggttattagtctcaaattcttttaaaagctcggcctgtttttcagcttccgttttttgcgaatcctggatctctttaagtctgtccaggccttctttcgcacttttgaagtctgagacgccgagttgcttgagtaatttttcttgtgcttttttcgcttctttggccgcaatgttgtttacctcttcttgcttgaataccttggcgtcctcttgtgaagtttgctgcgtgtttcccccgctgcttgattgactatcttccggatttgccgccggatcggtgttttgatcattagcgccgctgtttgtagaatctgaaaagaattgtatgttcaggcgcaaaaattttggtttctgtcccatgttaaatcctcccaatcgggtaatgtacttctgttttctttaacgcccactacagataaacgggcaataaaaaaagccttatcctaaatagacggaaggcttttcttctgacggtttctctttttcaacttctgcttctgcaattagataattaatggctctctttaaatcttctatttcagaaaccagggcatcatattttttttgggaaataaacataattttgctgctccttaattgtaaatttgttcgcgctctcgtcgccgtgtgcggcccgtttcttccaggaaggcccttaaccttgcctgcccgtctaaaaccttcctgcgcgctcgttttgctccaatttcatcatgcattttctcaaatgctgcaagctctcttttgttgtcccttatattgcgctcaagcgccctctgtttttggctgtctttgtatgctttttcgttgcgctcggcattaacagggtggtaacgctgttgcgaaacacctggaatatagggatatttaacatggccgcagttaattccaaataaaccatcaggttcacccatgctcgtacttgatagcgcaggatattggggatcattgccgcttctgctaaatatcttcccctgaaacggggcgcatttcggccgggctcccgaatgcgaactaatttccacaagatcaacgccataactcgtaaagcgcgcctcttgcatttcgttcgtcacgttgtttccgatagtgcgaatgacggtataagcgtacccttcagcatatctccggccgccgttggccgttttcaacacaggtataccctttgccgcccattgcttcattgtgtcccgtaaggcctgttgtgaggttttcgtacccgctaatacttcggccgttgttcttgtgattatgtcgcggtatatctgctctgactctttgagcatggtggaattgatcatgttaaaagtatcatgcgcctgcttctcaaatgcatctaatattttccatattgccggatcttgttcgacgggccgagcctcataaaacgccttcccctgctccaatgcttttttgagtataatttcattcggttctattccttcaaatccgacaccagttaatatttctctgatgactttggccgaaaacctactttttcgcgatatgatcttcacattctcccgtgttagcccgcctatttgttctaacttatcgagataccaggcgttagcatcatcttctaacgcttccggatcgtctgctaacaactcagcgatattctctaaaatttctgtttgaatggctgaatacaattgaacaatgggccatgatatttgttcgacccgttcaggcgttaccctggacattaagaatccccgctatatatctgatcaatgtccggcatttcatttgcttgctcctcatttactgcctgtatcatgttttttgcctgttcttcagtcattttaagaatacgcataagggcaacatatcgcggcatcaaacgattgttcatgatttttaaatagaaattggcgtttgcgtcccgatcctcagcaatggaatcatcaaaatctattgttactgtgtaatcatccggaactggaaatacatcgtaaagtatagccacatcacaaatggatgtaatcaggctttttagtccctcttcaacaatattttcatggctgttttttgatttaaacgtcttactattttcgcttacgacttcggttgccgttttgaccccttgcccgtcgaaagaaaacacgccagggctaaaccctatttgcatagcgaaaacatctaatagggattgtattgccttcacatgctcttctactcttaattcaattgtgttatcaacaatcttttggccgtctacatcctccatatttaaggcctcgtatgcctcgtcattagcatcaaaataacggttgatttctccggtatctcggttaacaattgtcctaattgctgtatgcggaacaatgatgcgccttttccctaatctgaattcacggttatagctatcaaaggcagtatcaagagctttgattgtgtcaatcgcatttgcgaacagtgatattcctaacgggctctgtaaatcaaagttatttgctacgttcggtttgatatagacaaacaaaggacgggaaaggccttttatgcgtgtttctttttccaaaccagggtatatgagctccaatggtacttccgttccgatctcttcgctcttgtctgattgaaatagttgattttttattacatatgtcgcgccgtcccactgatgccattcaagcaacgtcatccacttgttcccttttcgggtgacagttaagaacacaccttccgttatctcgtcattcgaatgggctatagggataaaacaatccgcagtgacatagcctatctttatgtttttttgcttattccgatcttcctcgatatatgtttttaacaccattcctccgagagcgaacatatattctaaatgtgtctgaaactgtctataaaaattgttgtattcaaaaacatcatttattttctcgaaaagattcttatcagaaacattgattgaacatttttcattgaagataaggcttgccatttcttcgcttgcaactttgggcatattcaatgaatccatacgccgggtgcgccgcccactctcaattgtcatataagagactttatgaaatggctcacctttatatttttccaagtgccctttatataacggcagccatacagtttcaatcaaattataaaattcatcattgaccggaagggctttaatgtccgatattgacttgatatttttgattattcccatttttagcatcaccgcctttattttggctattaggcttttgaacatcgtttcaccgccctattttacatacactttataaaagtaatttacgctatatctgaattcgtccatactgtggttatctttatcaatcggcttaccgttgtcgtcacgacaatataagccgctttcttttatgaaatggtaatgatcatatttttcatcatcaactaatcgaaacatatcttttgttatgacgttctgcgcccgctcgattccaacttcaatgcctttcgagctgcccttaatgtctttggcgttattgtcagccctggacgtatcaatgccaataatatgcagctcttcacgtagcgacttacacgccggatcaacaaaaaaatctctatactgcatctgatacttttcggtgcagtgttttacaaactctttgatctcccttgcgtatatactcatggccttcacttgccccgtatccgcgccggaatggtaataatgagcgacacggtttaggcggaattcatcttcataacgggtgacgatattacatgagacacttgtcgcgtcagactggccgccgtcagctgtaaaatacatttcgtaaggcttgccaagcaatgtcctttctgtgtgcgcctcaaggtcgagcattccatatataacgccctgcggattgacccgcttcccttcccaatctcgcttaaagagatacggatttttcttcagcgtgtcgtatatctcttgtttcctgtcgtcagtcaaaatagggttgtcgtgaatcgtccagtgctgccaccttgtgttctgaacatgaaacacatctttaataacagggtgattcggggcaggcgggtttaaatcggcaagatggtagcgcatcctggcagcaaatgtccgccggaagcattcctgaatcatatccatgtgcaggagattgatctcacaaaacaccactgagcctaacgacatccccgtaatcgccttaacgctatcaaccttaccgccgcccttgtaatagactttctttatccctgcgggcgtctgaacctctaaatgatcgcctaattcatcatgtttcactttggcaaggctgccgaattggtgtttgaggcccgtcccgtccccatctatgaaaagcctgtacgcttgttcctggttataagcgacgatcaaatgattttcgtccggcgtcaacgacaaatagagcgcatagcgaaaatggcccgctgtcgttttccctgaacgcggcgtgccttcgttggcctcaagagtatgatcaaaggggcgtgaaataacatccgcttgcttttcagaaaagttaatttccatcgtccgcattccctttttgtagcgaattgaatagatccgcaatgtttgagattagtgccgtgtcgcctttgtcgcctttcaacaacttaatgcgctcttttgtcagctcggtttcagctttcattttttctatctgcgccttgctcatttcgtctatatgggcattcttcggatcaaacatacctaaatgcttgccgatcatttcaagagccttcaggggatcaccacgctttattctcgttgtgatcttgtcggccgtttcgtcaccatacggaacttctgtgacggtttgcgtcaactcggttatgatcgtaccgtctatgtcttcaggatcgcgcagcttgacgcgccccgtctcttcattccatgtcattaatgatttaatatcagcaaaggcgaattttgccaactgctccaaaaccctatccgctgttatattggtgcgctgtgaccgcctctccatggcctcagaaatggctttttcaatcttagggtttcttaggagcttatgactctcaaccgcggccactgactcgcttttcaccttatatcctgctcttatatatgcttgtgtggcatttaagtctattagatattcatcaacgaatctctttcgtttaggcgttaatttgctcattacatcatcaccacctccatcaactcttcttaatgcatttattgaacatacaaacgtatttgtttcctgagaatgacccccacacgcactttctgcatttgtggttgtctttcgcttcttgcaaggccttttctcttgcttcttcctgctttattcgtgcgtatgttgatagtttcatattatccgtcctcattacgcccctttattcatatggagacgtttcgatattttgactcgcgccctgcgtactgtcgtctgaactgttccctttgctactccaagcatggccgcgatcctttcgtatgaaaatttttctccttcatgcatgacatagatttctttctcccgatctgtcaaaacagaaagatattccctgattagcccttcttcttcttcggttacaccgttgcccgcattcggccgcactgaatgtttatcagaatacatgtgggccatcatttcaggatcttgaatcaacaatcgctcccacccgccccgtctgtcgattgaacggcgtaaccctggctgccttcctttttcgataaattcaattgtccattcaagatctgaaatgattctcctgaccgtctttaaatcgtttgcctgctttgaagacggattttcttctgcttccgctttaatcttttcaaagagataccttgtatcatccaatgttttcgtgtaactgattaataaatctctcatgtcttttccctccttaacacaaaaaagcgaccccgtgatttcacagtgccgctcttccggaaatgatatgtgattgaaccataaaacctgactcccacaatcaggcgcggcccttgaccctttcacttaaccgcttgtgtcacccatacgaacgcgacaccaccacaataaagacggttatcgttatacgaataccgttggcccaatcatacacatggcatatcggacggcgacccttgaccaccccggccgcttgtgtcaccctcgcgaacgcgacaccaccacatgatcacaatgacaataatatgattgatattatgatcattattgttattgttattgttattgataacaatattgttttctattcaatgtagaattcgccagtatagaatgtaccttccgttctgacgtgattaccttttgaatcgtaacgctccacgtctgctttgaaacggtacgttcctttcttgctatcgaacatttctttaatgccccactcgtcaacgtcgtgttgatccggctttaatgggtttggagaattgccgtctaacgttttccacttgccgttttccttacgctgcagggataaattagggcctgcaatgtagtcattgtcatttttgacagcgaccttcaccactttgtctttgtctaaaacatggtgctgctttgttggatttgcgcttacgccatatcctgatgccattctgcatcactccttttaatttgttgtcccttcccactaaaaaagatcactgtcgggggaaacagtgatctaacaaaaggcaatactttgacagatgaacatcaaagagaaaggggataaaccattatggaatttttccaccgccgcaaggtcggaagccctgtaagacttcctgataacataatatcacaccttaaagggtaaaaagtaacgacaaagtaacaaaaaagtatcttttaaggagactgtcgggcaaaaaatataatcttaatccagtttgagtatatttgataatccgatcattagcttatcgattacgatatttctgatcctatgcacatgtttttcgtggtatcccatgactgcggccacttgcatcattggcttgagcttaaaataacgttcttcaacaaaagtacgttcattcttttccagtctgctgatcgctcgatctattgaatttactatcaatttatacatttccatatcctctttgagatccaacgcctgtctactttcaagacgatctaaaaccgtatcctcaactttgctcttaatgttgaatgttccggacgatcctgcatctgctgaatataccgcggtaacgcttggcaaaatccaatctaactgttgttgtatgttcgcaataccgactttgtaagaattataatgtcttaaatagttttcaatagctctttttttgtctattctttctcgtttcataggatcttatccgcctttctgtcttagatgctttggcctttctcggcttcctcaatttttcggatggcagtctccaggtaaactgcattgtccaatgtttcttctaaagcgtgctgcagccattcttttaaactgtgagaatcggtcttaatttccgttccatactttttcaatccctttgcctgctgcgcttctattttcttatagagattgttaataatcggattttgtgtcatttaagattttcctctcttataatgagtcctaccgtggtaacagacatttttacgcttaatttctttgcaatgtccttatgtttatatccttttttcaagtatgattttatttccgctaaaagctccggcgtgcgttcaatttttttgttttgcaatggtatccccaatgagtttctatgatcgttatactcccacatatatttaaaaccaaattcctttgcaatctcgtattctttcatccccttatcttttcgttcttgccactcttcacggctgaaataatgaatgtcgggatactcttcatcaagattgtttttcctcttccaatgggttaggactctgggtgaacagtatagctgctcttccgccatttccgcatccgaataaccctgttcatacaaatttttatattgttccttggtgaatcctatctgatcaagaatacacactgtcagcactccttttacaaattataagatatgaaaatccaattactcgttgggcttcccacgaatcccgtccaatttgatttactatatagattgtatttgacgatgtatgttccgttcccggtatttctccgggcagacgtcacactaaattttttcatcggcgttgatcctgtgaatgatccggaactatattgccctgtatgaattaatcccgaatccgtccatttgtacaagatcgctttgtaataatatttcttactgcctttcttttcgattttataatctatagtggtggctttcgctgtgtacgtcgtcgcatccgtgtatacccgcattgtgccgcctttataatttccccatggcgaccatgcggcggaagcagacggcgcaacggccgccgctcccataagtaatgctgctgatagaataattgatttaaatagctttttcatcgccattccccttttctgttttttgtctgttcgccttaaattcttcgacttcttcctttgtcccgatttcaattcctagatcgaatgtttggttaatttcatccacatattccgttaacattttgagtccgctatcgtaatctttttgctcccgaatataatcgtattcaacttgggttccgcggcgcgtcggttttaaaaacttgcttggccgctttaactcgttcaacatgttcatccatacgttagcaattctcatgctgtattgagctggatcatctttgtaaagcttcatagttaatttagggaaactcattttcccgctaataacttggaatttaggtttttcatttttcatgattgttcattcccctcttcgtcctcaaaatcattgatattacttccgcttaaccatccgcatttacagaaatattgaaataaggtcggttcaagatacctcctatttaggcacttccccgtcttcacggaaaattcagctatccacgcttcttgcgcccttattttaatgctgctgttcccgcattccgggcattcggtgtattcgttcattccgtcacccccagaaataattcacggcactcacagcgccatatacgatccaagagagggcgaaaaacaggattcgccagttttgcccccggatcattttgttttgctcctgaatcgtccgcgctaaatcttcgttacgcttttccagttcgataataacggccgtgcatcttgctcgaagctcttctcttttctccatcactccgcgccctccaacaactcaggattttcaaaaacgtttccgacaacctcgatttcatcaagtcgataccataagaacctatccaattggctcttcttgctgacatggttcattctgtcgatacctttccgtctctcaataacataacggtcaataacattttctttgagtaaaggattcacatacgattcctcagtaatatccttttggtatacgtctccgtcgttcttatccttcaacccagttccccacatgagaacggatcttccgtcgtaactttccgcaacgataaccctgcaaccatcacgccataaaatccatttatctccttttatttcaaggctcaatccttcatcatcccaataatgcatgtgctcgccgtcccacactctgtatgctgtgttcattctagtgaaccatcccaaacaagcatttcacccgccggaacattgaacgtttccataatcagatgatgatcggtttcgccatattttttcatcactcttttgtattcactaagggcataatcacggcttacctcattgatttcttcatcttgaaaattgttgtaatcgtccgtattggcgacttcctgaatgtaaattttctcggcttcagccttgtcttccgctttgagaagcgcgtaatatggattaaggatttcatagaatttcattgttttctccctcccatctttcgatataggcaaacccgtcagcctgcaaaatacatccaaaatacggaagtctctccgctcctgtcagcttctcaacttccggatcgtatttccccaattcatcaagatcctgaataaatttcaaaaaggacggatcgaatttttgtatttccctcgccaacaaagcatcacgatagccccaaatcgtcgcaccattctcacaggctttcattaaatcaatgtgtttttgctccaatttcacttccaaaaggtctttactcattctgcagcccccttcaatgctttttcctgcgcctctgcccacatgatctttttaaaatcatttgaatttattgccacactctgaaaaccacagtgagcgcaatggacgttactcggatattcaagattttcgatatacgtccaatcctcacactcttcacaatagtatccatgcaattcttctttgtttacattcattctgcagcgtccttcagtgcctgatttgcaatatgttcagctatttcaatagaatcaacttcaggacttccggctattacatcgagagatttccgatagtgttccttctccttagtaagccgctgaatctcttcccgcgcttgccggaattgaataactatgatctcctgttgacgtttgttttcctcgatgattttctgttgtttagcagacaattcagcgcgatcaataagaaaatcaatatgttttttggccatccagtattgatcttcaggttttgcactttgatagccttttaattttgaaatgcggcctttaatttcctgtaatttatccatgtccgttcctccccggcagggaatgcccctgctgtttgatttctgaatcaaaacaaactcatttgatggcattcattctcctgatgctcttctctgaatagatactcagttacttcgaaatgctctttttgataaaccccgcaatgggcgttctgattatcaaatttagatacatagtaatgactgtcacccaagggaaagagaaaatattctctgcctctttccaatggtgttatgtgtgaggtaagacatttccctttcatagctgcttcccccgtttaactccctgatctctctaatggttttacgccttgtttcttcggccatttccatgatccgcggtgtctatccatgggtataatcggatgttttctgatatactgcagacgttcttcctcagtcattttccaagtaacaaccttccctggatcttttgaattatttgtattcataccgcttctctccctctgttttatatagaacgccatgccgtttgctgaaaggtattcccgcctttgccccttgcttatttattccttcctcgaaaaccgtaattattagcagctcttcacggtctaaattagtcttagaccattgaattacacgccttgtcatggctctgttctcccttcgtcagaatggtagatcttcgtctgatatatcaatcggctttccttcatttttgaatggatcatcgctgtcataataatgattatcttttcgactcggcccgttatcgcggtcgtcctgctgccctccgttgcttttcggctctaaaaatttaactgattctgcttgtacttccgttacataaacccgttgcccatgctggttttcatagtttcgtgtctgcagccgcccgtctacgcccgcgagcgcccctttttttaaaaaattcgcgacgttctccgcctgacgtttccacgatacgcagtttataaaatcggcttcacgctctccgctttgattcgtaaatgtccggttaactgctaatgtaaaagtcgctaccgccgcgccgttcggtgtatatctcaattccggatctttcgttaatctgccgactaatacaactctattcagcatgtgacttctcctgctttcgacgtttttttacttttttcgacatttttaaagcacaactcaagataatcaagaggtacacccctacttgttttgatcggatcgcaattcagatatatatcctggtatgggattgacttccggccgcctgatttggctgcatcccaatatttcaagaaaaacggtaatctgacaaaataaaactcctttaattttgaaaattcaatcaatagaaaggagataccgccttgatccataaactttttcaggtactctacttgatgatcatgaacgttatctaaatcgaatctgctttctacttttgttgatttagcatcgaatgcaatgccgcggccctgggctatgcctacatagtcaacggtgcttttcttctcgtatatcatccggccgcgaatgttttttgtcggtgttgctatttcgtctaccaacgcccaccctttatgcccgtatatcgcgttagtatggtttacaagaatttgaagggccttacccctgtttgcatgattgatcatttagtagcctcccaaatggttatgattaggtatgccgcaaaaccgacggtaaggccctgtattgcccccattaatataataaaacctatgtccttatatgttgttcgtcgcatcatacgtcccccatattccccccatagctattctgaggctgtcgtttaaacccgcaggccttaaaagcgtcttcgatgtaaccggaattcccataacgaataacgtccgcgtttcctgaatgagctttttttcattgtgtgtcacaaattccatttctgttacccgcttcatgataccgccatactttgacactgcttctcttttaatcattctcatatcagctcccacggcaaccgctcaacacgtttcatgcgcccaggattaccgatatatttttttaaaaagcttcttgcacttgtgtaagaagggaaatggtatccctcatgccatttttctccctggctttctttatagctgtaataatagtgatttagcagcttatatatacaaaactctgctaagggcgttttgctgtaccatatctcattcattctgccgcctccatgtctctgactatttccttatcggcccgttctcgcgtgccgtcgttacctaccgtcaatttgttcccattgctgaatctgcttttctgttgctgacgctttgaagaggaaaccgcgtccccaagaagatagaagaaaatgcggaatttaaccacgtccgaccacattccaattttaaaaatcccctacttattagaaacgcgtccatattccctcagtccttttctatgctgtttcctttgtagcgttttttatccagtgtttaagctgctcgataaggttataagccaatccttccggtattttttccggttctgtcgtaacccctatcgccttataaacttgatcttttgttacattgcgaatttcagcaaaacggcccgctagttcttcaagctcttctaattgttccggcgtaatcggtttaggcggttttgactcttcaactttttgttgaaaagcgtctgggtcgtcgttgtctgttgggatgttgaattgtttcagaaggaaatacttttcagcgtatgttaaagcctttccgacgcctttttctcctgctctgtcaacaccctgtgcataaaacggcacaaccattgtttcttctgggttttctgcattaatccatttgaattccattgtcaattcagtaaaatatgttgttgtttttttgttgacgtttccgcttttatctttgaattcaactgtttcagttcgaacgtttttgtcaataattctcggcacaagtaaaagccctaattcatccattttctctctgacagccgctactacttgacttgagctcgtatactgatattgttcagctttatcaccttttttcaaatacgggacggtctttcttacctcgataagcttctgataaatgttcactcgttatccctccaaaaccaatgagaatttatcgtctctttcgattacggtaacgcctggcacgacttgcccgtttgggtctatcaacttatcaccgacaagctgacatttgtttttaatagatgaccaatcaacactttcagacacttttataaacccttgtgcctttgcatattccttcaattcttcttcgttgcgattgtattccggttgctgttttataagctttaccgttccatatggcagcttcataacctttttgggtttatgcccctttttcatctgttcttctatgtcctgcctcatatagcactcaagccgattttcataaaacgcctgttgcttgacgtatttttctttttcttgttcctgccacaactttattttttcgattttgtcaagaaacggtgcgatttgcttttctgcgatcttgtcgattttttgttgttcgtctctgaagtaagcgattcgcctttgtgcctctgccgctgtttcaaggtctgatacttcaaacgcctgttgttctgtttgctcttcgtattcctctgcgataacttcttttgcaaatggatcattttcaaaaatcacaaaattattttccatattttcacctttttctattgaattctaagggaaagatggatataatccctaaatataggggtgtcatatccacctatcctaagtaaagttctgcaataactttacttgtttgttatgcgagatagagcctttgcaaaaaggttctattttttattggacgtattctgatacctgtttcagaaacattctcatacattcggaatcatcatggattagatcaccttcataattgaagtgctcttcaccaactgttatgacctcttgacacccttcgcaacttcctaaagcctttgtttccggaatcctttcgtcaaatcgtgccattgaatgaagtctgctcatgcccgaacgctcctttcactgtttaactgcaagtatttttcgtattgagccttgttttcaaattggaacacaggtgatcccgcctttgtgaatcccatgcttcctcccgattttcctaatctccattgatcaaatgcattttcactaaattggattgttttataagatttcatttccatactccctttctgttttttcttttccattgactaaatgccgtgttttctaaaagccataatctttgttcccccgtgtaagcgcgccacacagaaaccttaattttcatgatgcatttaccacttttaaatccattcttcgtttaattgcttcgcgctgattgtaaaggttgtcaacttcgtcccttatagcaaaggcttcaacaaattccccgtttgttctaagaatttcctcaatctgtagcaatacaatttgcttattcaaaagttcgtaatacgcatctctcagattcttcatggtttcccctttcttcttttaagagactaaaattaagataaacacactttttcatccctaaaggagatttcttgggtataaaaaaatgttggtgtaaatcctaacgcatctgaaagtttcaaaaccgaatcaaaagatggatcggcttctccattttcaatccgccatagaaatgaacgtgcaagccctgtttcctccgaaagtcgatcataggtaaaaccttgagattttctgctttcagataaccaaattctttttttgcgatttttcattgtttttgtttcacctcttttcttttggtgtacccttattatattcccttaaagggaacatttcaatacctttttataaaaaagttcccctaaaggatatttttttgaaaaatggtgaaacttcagtcgttttcacacgtaaaccattattgttgacgttttctttcaggggaaaaaaagaatataatatacattggatgaacattagttaggaggaagggatgtatttatgtacggtaaacgtttggcccatttgcggaaagcgcatagatacacattagagtatataggcaaacagttaggaatagctaaatcaagttacgggggatatgaaactgaagccaaaaaaccgccgctagataaactgacaaagctcgcggaattatacgacgtatctgtagactatattttaggattgaccgacgatcctgatccaaaaaaagagagaaaagacgtttcagaattcttacaaaaagaggatttgcattggaatggccgccctttatctccggaagaattagaaccaattagacatatactcgaaatggttgtaagagatcgagagccgcaaagaataaacaaagataagaatgaaaataattcgaaggcgaataacgaacagtaggccccaaaaaaaggggcctttttttaatcataataacggcgtaacatttcttcttctttcttactgatacttcccgtaaatcgcaagtaattaactaaagtcttaacattcgacagatcaatacccgatggttgaatacctcttctctcccttgaattgacccacaaagaaagtagatttttcgtttcttcaaggatatgcgcgttattctccggttctaagtttgctaaatcgcccattgatccgtcccccttttaattttcgaacgtttgttctcttattataccataattcccctgaaaattcagagatcgtataaattatacacctttgttctacgactttcagagtggttttgtttcaaaaaaaagaaagcccaggtatatcccaagacttccttactttttttttacatcctataagggtacatcttaaaagacattttccacaaaaaaaggattcatttttcgaaaaaatcccttatagcatacctttatcttttaaaacttgtttgactgccgcatttacaaatttacttttaatttttttccttcctaacggctttaaagcctttgctactgcgggttcgaagtaaatccctaattgaacatgatcatgattatgattgttattgataatatcatcaatatcatcattgttattatgatcatgattatgattatgattgttattatgattaatattgttatcgtcctcagaatctttgtactgatcaaaaaaggcggctgtaggactttttattctatcctttaagtttttctgcttatttgacacgtttttcaagctcctttacaaacgggatataatactctaaagcgctgctcagttctttattatctaagaacccatttataggcaggcgtcttgttgctgcttttcttcggatcatgctgtcaaaacgcatgttagggtattcctcgtctatcaattctaccatcgcatcattttcttttgctcggctgtcaatgatagcaaaaaggattccggctaactgcagattgtcattttgacgtttctgcgcttccgtaacgatgtccaaaaatttctgaatggcatagtaacaaaacatagatccgtcaaacataataaccgcataagaccccgcaggcgaataagtggataggcttaaaacagtttgttcaccgaggttcggcggcgtgtctatgatgatataatcataatcgtccatgactggccgcagcgctttggttaatgcgttaagcccctttttctcttgatacattattcgcggaagcgtcgctaggtagtcatttgatggaattaaatgcagattttcgctgattttcagtatgtaaggtttagcattctcttctttgatcgcttccaggattgttttttcttcaaacacattacaaatatcatactcacccgtaaggaaagaagtaagattcccctggccgtccatatcaatgcacaaaacccttttattttcactcaaaagccatgctgtaatgccactagttgttgatttagaacatccaccttttgagatgccaaacgtgattatcttggccgtcatggtattccctccctcttcatctttgataacaataataataacatgattatgattgttattgtgattatgattgttatcaattaaaaaaagcaccctaaaggggtgctccttaaaaattatatccttccggcgtgctgccgttttttatatcgttccaagtgttcagcatttcgtttttgctctcttgcagccgtttcaactcttcttcgttcatttcctgtttatcttcgtcggaagatccaacccattcaggctttttctcttctcttggttgtttaaatgtttctctctttgcatcgtccagggcttttttaaagtatgatttaaaattcttgacgtttttcttttgtacacagtcaagaaattttgagtttaatagatatttatcgtcaatcaatccatcaagctcttcataagcttttaggtgattcggttttatctcgtcagcgtactttaacaaaaatgttttctgttcttcactgattgatagatgtgtaatatatttatgtgtattctctttatg

SEQ ID NO: 134 - DNA, 32809 bp, Bacillus velezensis FL50S
acggcagccggcttaaccgggtttttcggctacatcggaggctctgctttcgccaacgccatcatgggttatgtcgtagaccgctttgactggaacggcggctttatcatgcttatctcctcatgcgtgctgtccatcgtcttcttggcgatgacgtggaatacgggcaagcgggcggagcatgtgtaagaaaacaacataaaagattaatatttttgcagtacagcatttacaacgattttctacactagagacagatattgatttttaagggggaagaaaacatgcggaaacataagttgtttgctttggtattgctttcattcggtttattgtcattcatcgtcacgcctgtatcggcggcgggaaaaggaaacctcttgtctcctgacagaattttaaccattgcccatcgcggtgcttcggggtatgtcccggagcacacgatcctttcttatgaaactgcgcaaaaaatgaaggctgactatattgagctggatttacaaatgacaaaagacggcaagctgatcgtcatgcatgatgaaaaactggaccgcaccacaaacggacaaggctgggtgaaggatcatacattagcagagattcaaaagctcgacgccggttcttggttcaataaggcctatccggaaaaagcaaaaccgcaatacgccggacttcgcgttcccacacttgatgacgtgttaaaacggttcggcagacatgcaaactattatattgaaacaaaggcgcccgaaacatatccgggtatggaagaaaaactgatcgcctcactgaaaaaatacaaattggcaggtaagcatgcgaaacttggacaagttatcattcagtctttcagcagggagagccttctgaaaatcaaacagctcgatccgaaacttcccgccgtccaattgcttgaagcggaacagatgacctcaatgactgacgcagatttaacagacatcaaaacatatgccgtcggaatcggaccggattacaaagcgctgaacgctcaaaatgtccgaaacattcgcagccacggcctactgcttcacccttacaccgtgaacagcgagacggacatgcgccgtctgctgaattggggcgtaaccggtgtgttcaccaactatgcggatatatttcaaaaggttaaaaaagaatataaatcataaagccagcatgggttcggagatgatgccgaacccatgtttttttgcctgatcaaaaaaccttgcgggaacgttaccgcaaggtttttatcaatcattattcttttccggcagcggcttccgcctgcccgccttttaattgatcgttgattgctttggcgtctttcaaatactcagtcttgaatccgctcttcagcgcccacgcatagaaggcaagggcaacgattgcgatcagccccatatcccatccgtacggaatgatgttcagaccgccgaatttttcacttccgagccatgaaatgaccatcatgctgagcagatagacaaccatccaaacgccgcctttaaagtttctgcggaatcctttccacttcgctttcgcttggtagtagaaataaatcggaaggccgatcaaaatgataaacagcacctgccctgttaacggccagcgcgcccaatacagcacgagagacgcgaacacgaagccgagcggtgcaaccacgctgagtcctttcagacggagaggcctgtacaaatccgccgccgtcctccgcagcgtcattaccgtcacgggacccgtgatataagaaatcagcgtcgctacggaaatgatttcagcaagcacgccccatcctctgaataaaaacagaaagataaacgatacgatcaggttgaaaatcatcgcttggcgcggcacgccgtacagcggatgaagctttccgaaaatgctcggcatatatttatttttttccatgccgtaaatcatgcgtgacgtcgtagcggtatatgtgatacccgttcccgacggagatacgaacgcatccgcataaagaataatgacaagccagttgatattcaatgcgatcgccaaatcggcaaatggagagttaaagttcaggtgactccagccgtgaacgatcatggaaggttcaaccgcaccgataaatgcgatttgcaataggacgtaaatgacggttgcgaccagcagcgaaccgacaaccgcaatcggaatcgatttgccgggattttttgcttctccggccatgttaatcgggctttgaaacccgttaaacgcaaatacgatacctgatgtggccaccgccgtcagcacgctcgcccagccgttcggcgcaatgcttgaaccggatgtgaagtttccgccgtgaaaaccggtaaacagcagcgctccgattgtcagccccggaataataattttaaagatggtaatcaatgaattcgcttttgaaaacaagttaactgtccaataattcagtaaaaagtaaataatcagcaatacggatgcgaagccgagcccctctcccgtaagtgtgccgttgtgaacgagattgcttgtccactttgcccagtcccacggccatgagctcatatattgaacagacgcaaccgcctccaccggaataacggaaacaatcgcaatccagtttgcccatcctgcgataaatccaataaatgatccatgagaatattgagtatattttaccattcccccggcttccgggaacattgaacccaattcactgtaagaaagtgcgataaacaaaattacgatcataccgataatccaggaaataattgcggcaggtcccgcaatctgagccgcccgccacgccccgaataaccaaccggagccaatcatcgacccaagtccgaccatcatgagtgcaaacgttcccattctgcgatgtaattgattcataaagttaacacctttcaattaaaatatgactccagcgctatcatatatttataatattattctgaaaatagttttgtcaatctttatcgcattaaagcggcaagccaaaattaaccttccgatgtttaaacagccgttaagcgggaataactactgcaagccagaaatagaaaggagtttttatcgtgaaacaaaaactgctcatttcaggacttgccgtgtcgactgtcggagtgacttcctacctgctcaaagataaatcaaaccgccaaaaggtgatgaactttatccgcaatatgaaaacatcgctctccgggaagcaggatattgaatcattccccgtcaacaaagcaggcaacccgcatcccgaagatattgaagataacaaaatggtatccgaaggctccatgtacccggttcaatattatgatgacaagaagaaataatctgttcccgggctgcccggccgtatcaaacggcggcagctttttttatgcagacggcgttttatagatccgccaatattggcgcgatcctttctcccgcacggtaatgcccagtttggatatttccgctttcagctctttcgcatcagccttttcctcctctttcagcgccttttctctcgcttttaaaagagcatttgccccgggctccaaatccggcgtgtccggcacccaccgtttgtattcttctttaaaaggatcttccgttcccagccagacatacccatgcgcgcgaaacgcatcagccgctttttcaaccgccggctcaagcttctcccgaaaaagctcctgtccttcagagcctaataagacaagatacttcccatccgtaaacacaccggaaatgctgtctttcgaaaacacgctttcttcattatatatggttaaggacaccccgctgtccgtcacgactgccacaagactttctttaaaagctgcccgcgtcagccacactcccccaattaagccgataacggcggttgcagccgcagccttccacccgtgaaaggaagcgattatttccagcggcccgtgaaaaggcagccaatccaatgttacggcccacttcgcaatgaccggcagaaaccatccgatgaccagccccaataatggcggcaccagataaaccaaagctttttcaaccgatgacaactcaagaaccgtctgtttttttatttcgttcatgtttctcctccgtctgtgtttttcacaactatccattatacaaagggttggatgattctgtaaactggttccgaaacaataaaaagcctcccggccgccgggaggctttttaaaacaggagctcatatacttcatttaattccatcgtgcgcttctcatcctgctcgttctcagcatatttgatttccttttcaagcacctgattcagcgcatccatttccagatcatttagatctttcacgaactcgccctcatttgcataatgcttcacctgaagctttttataaaccccccggcacacatcatgctccaagtggttcgaaagcgactcgcgcaaatatccgagtgtcctgtccatcatgtaagccctcccttttctttaggaatagcttcccggaaagagaggaaaactatacatgaaagcaccgggcggctgttttaactctgtacctgaatggagaaaaatccgctgcttaacggcgtgtacggcccgttcagccccgttgcggagaaagagaacgttcctgaactgacataagaaagaggaacgctgtaatatttaatatagcctgtaacgatattgccgtttttcgtatattcatcttccagcgcttttgacgtaagatttgtaatattcgttccgttgttaaacgcctggatcgtattattgttcggatacccttggaaatatacggctaaataacccgttgtccccttcatcggttttgatgcgctgatttggttcggaccgatattttcccattggtaattctgaccgtcagacgtcacaccgataatacggatttgtgttaaagcaggagccggcgccgcagacgctgacggaacccacaacccgctcacaagcaacaaagcagcggcggccgcggcaaatagcataacgagtctctttttcatgtttcttcctccttgtggttcaaatttataattatgttaaatattataagtttcattttatcagagaaatcaatagatagacagaatcaatcagtcaaattggtgaactttttatataaaaaagctatctcctaaaggagatagcttatataacattatttctttccacactccaaaattgtgtatttactcggggtctgaattacatttaatagtgttaatccggctttttcaatcaattgttcaaactcggttttctttctgactctgccgcctgcagagcatactaaaaataataaatcacgaaaagcttcttcaggggacagcctgtctgcttcaggcacattttcaactataatcagcttggaatgatcagacatggcaccggctatattttcaagaatagcaaccacatgctcatcatcccaatcgtttaacactttgcttatcacatacaagtctccgccggaaggaatttcctcaaacatactcccttccgtaaactgacagcgttcgctcatctctgaagatgctaaatgcttttttgcactttgtatcgtttttggaagatcaaacaatatcccctttgatttaggagccacacctaaaatgcctgttattaactggcccattcctcccgcgacgtctacgataacatcaaacttttcaaatgagtaagctttcaatatggatggcagactcatttttgaataaatctccatcgccttatccattgtttttaagtaatcttgatcaagactattattctcataccatttatcaccataaatggcttcaaaagcggatttgccggttttgatactataatccattttaaacatagactgcactactgtttcatgcagcagatattctaccaaaggctcaatggattttgctttcccaggcatcaaagtggcaccatactctgttacatcataatagccattttgagcttgggcgaccaaaccgacggattccagcgctcttaagagcctgaataaggcagaggggttcaattcaagggcttcagctatcgcttccgctgaagctggtccattttgaaaggcggaaaatacatccaattctaccgctgttttaactgccagggaaaaccccagccctgaaaccatttgcatgactgcggcctgaggatatttcttcggtacttgtttatcttgctgaactgaattggtcatttacgttaacctccgattaattaaatggtttctgctgcttttttgatataacgcatatactgattgagcagattttctacagtactcttatagtactgattttgattatattcaattccaatgctcaattttttctctcttaccaacacaataaacttaaacttgtaattccaaatttcatcttcacttatatcattcccggttgaaagcggagataccgtaaagctttctgtgtgcagttcattatcaaattcgcccatataattaaatgaaatgtctggttttgatttctcttttatatcttgttttaaatatcttaaaataccatatcctatcccttgatcaggaatattggctaaggtcgagttaacattatctaaactcgaaccgatatgatcagaatcggagacctccaaagccaccggatagattgcagaaaatctgcctactgttctgtagatattaagcttctcactctgatgagtgcggccatggttgcctaagtgcacgagagatgtattactgcctgtttgatgttttactgtcaaacctaaagctgtgagcaaaacagtctcaatagtgaaatgatcttgtccttgaatcgcattcattatattttcagtttcccgaacattaaactgcctgtacacttgtctgttatctttgactttggcaatttgcccctgaatatcaaccggaatagacggagtataaacattttcgattttcgtccaatactctttctcaaacaacagccgttcactttcagcatatttatagagataatcagaccattttaaatacgaatcggttttatttggtaatacaatgtcttcgttacttttaacttgctgatatgctgtattaaaatcttcaagcagtattctccaagacatatgatcaatgatcatttggtgaatgacgattaacagatgttccccatctgcttccttaatgagtgccaatttaacaagcgggccgtgagtcagatccatactggcttgtatttgatttattttcatttttaaaactgattgcggcatgtttattgcattgatcagatgaaagtcaaacaagtcgccgtccgtcaggcctctgattacctgtaccattctatcgcctttacgtttgaatactgttctcagactgtcatgatgctgaataatccgggtgaaaatgtcttttacaatatcttcgccaaacccggcttccctgtataacataaaagaaagattccgatggtgcagagtatcattatggctttcagccagccagcattgaattggcacaagacgggcttctcccgttatcacactgttatcagatgccgctgttatataactgactttattcgaaactccttcgattgtctggtaatgaaagatgtctttcacttccagcctaagattgaatttttccattctgaccgctgcttgtatggctttaattgaatctccgcctaaaacgaaaaagttatcttttatactgattttagaaacttcaagaatgtcggaccaaacctcactgacgattcgttcaatctcgtttctcggagcaataaagtgatgcagctcggcattattttcagctggaagcggcaaacgttttacatcagtcttcccattgttcgtcaacggaattttatctatgccaataatgactgtcgggatcatatattccggcagatattccaataagtattcttttagctgagaaggcggctgcgtatctttacatactgtataggcatatatctgatcattgtgagcaatcgcaaccgcttcttgaacattgcggtgagacagcagtctgtttataatctcatccagttcaattctaaatcctctgatttttacttgtcggtcgattcttccggcaaattctatattcccatcctcattccacttgcctaaatctccggttttatacattttctcaccagaatgaacaagatccgggataaatttagccttggttagttcttcacgattgcaatagcctcgtccaactccttcccctccgatgtataactctccgataactcccggcggcacaggcttctgctgtttatctagtatgtagatagaacagttttttatcggtgtgccgatagggattctctttatattggaaatattatcctggtttatcgtataagctgcagcatcaacacagcattccgtcggtccatatacatttgttatataaggacggtcattctttttaaatactttatagaaacgctttacttcttcaggtttaagcacttcgccgcctataataaaatgttttacacctatacggccacactgcggagactcagagagcaggctgagataggctggtgttccatcagaaatagttattttattttggatatagaattcagcaagtttcgtgatatcatgcctggcttcttcagagacgatgtaaagagagtgtcccaaaagcagtgcagaaaaaatctgtttgacagaagcgtcaaaagaaaagggtgccaacaacgctacattctgctgcccgccatgtttgcagtagatacgttcatgcagggcttctgttaaattcgctatacttttatgttcgatcatcacaccttttgggtgtcccgttgatccagaagtgtagatgatataggcaaggctatgcccttccgttcctcctttaacattcctcccgtcgtctggaactgtttccaattcattcagacaaacactttctactccgtacctttgaccatgattgttgcgatccgtcagtaacaaacgggccccgctgtctttgagcatatactcaactctttcttgcggatatgatggatcaattggcagataagctgctcctgcttttaaaattcccattattccgatgataaaatcagtggttcggtctgcagctatgcctactgcttcattctttttgacacctttttgaatgagtgctcttccaagccggtttgcatttttgttcagctcactataagttaagcttccgtcttgtgcagacacagctatttgattcggcgttgcttccgcctgcttctcaaaaagctcacagatagatgcatctgtgcctctgcttctcagtgatcttccactgtaactcaatatttcgcgtcgttcattttcttctaaaatgttaatctccccgattagtccatcttgactttcaacaatatgattgaggatcattaagaatcgctgtgagaatttttctacagttgtgcgcttaaacaagtttgatgaataagtgaactcaaacttgatatcctcttttgaaggaaatgcttgaagcagaagatcaaatttggctgttttgttttcataaagatacggcttatatttcagcccatttacttcaattgccggattatccatcagctgaaggacaaacataacgttgaaaagagcattctggtttatatccctttcaaggttcaaatggtctacaagttcttcaaaaggataatcttgattttcataagctagaagcgcattatccctaacggcttcaagcagttctttgaatgttttgtcggcagatggtttatttctcagtgccagcgtatttacaaacattcctatcatgttttctaattctttatgctttcttccggctacaggtgtgccgataataatatcttcttgaccagtaagtttatggagaagcacattaaatgaagccattaaagtcatgaaaagggtgactttttgttttgcgtttaattctgttaacttggcggtcagctctcttcctgcataaaaatagattcgttctccttgatcatctcgttcggcttctcttgaaaaatctgcgggcagattgagaacgggaatttctcctttaaactcatttaaccaaaaatctttttgttttttcatttcttcagtatgaaataattcattttgccatatcgcaaaatccttaaattgaatgttcaatgacggcagttcgttgccttcgtataaatttatcaattccctttggaagatcgggatagacgccccatccgctataatatgctgtaaatctatcattaaaagatgtttttgatgactaatctcggctaatcctgcacgcagtaaaggagccttttctacatcaaacgggcggacaaaattagacataaggctctctaattcttcttcggaggtcttgattctatccattttaaatcgaacgtctttttctatgatttgaacaagctgcccgtcccttaaacctatggacgttcttaaaacctcatgcctgattattaattttttaaacgcatcttctaaacgtttatcgtccaactctccttcaatcattaaaaagaacgggatattataagaagtgctgtttttatttaattgatctagaataaaaattcttttctgtgcagatgaggcctcataccactctaaatcgcctgctttgggaatcacattcacatcatttgtcttcctcagagaatattcatccaaataagctgagaagagttttatattcgaatgctttagcaagtctgaaactgaaagctccgttccttgctgtttattgataaagttgatgatttctattgctatgattgaatctccgcccatttcataaaaatcggatgtaacaccgatcggattgattccaagggcatttccccaaatttgtcctgccattagctctgtttctgaataacagccgtcttccctgccactcagtcttattatttgaggcttgttgactgaagggttatctggtgcattgcttatcggtaatttttcaggcagtttcacccaatgtctctcctgcaaaaatgcgtaacccggcaagctgatttttcttcttttttctccttcatataacatttcccaatcgatctctgcacctttttcatagagcttgcttatatcaatcagaagactctcatctgttctcccgcctgcattataagccttaagtttttttccagcagcggtacttagatctctatcggtcttaaaagaaaatgcagcttcttcttgctgaaccggcgcttcgagcagactttcaagtttttccttcagatcttcgatgtcttttacgagaaaacacactctattctccagatgttttcttcccgtattcgctgtataacaaaaatcagagagattcaaattgttttcttccgagataaaatgaagatactttgatgctatatcattcaggacggacttattttttgcagacagagtgaatacctcttttacctgtctctgttcagtctcacctattatttcaggtgcttcttccaatacaatatgacagttggttccgctgaagccaaacgaacttacaccggctcttcttggcgtctctcctttttcccaatttcttatcatgtcattcacataaacaggtgaattcgaaaaattaattaaaggattcggttcattaaagttgatacttggggggatgaccttctcttttaaagccatgcatgctttaatgagagacgccatgcctgatgccccgactgtatggccgatattgggtttgactgaacctataccgcaaaactgctttttatcggtatatttcttaaacgcattcgttatccctttgatctcaatggggtctcccaaaatcgtgcctgttccatgtgtttcaatataagaaatagtttccggactaatattcgcattcttccaggcacgtgaaatcaatttctcttgtgattcagcattaggagcagtgattccgttagaagccccgtcattattcgtagcgctccctttaatgacagcatatatgtggtctctgtcttctatagccctatgtaaaggttttaatacaatagcagaaatcccctcaccccatgcggtcccctttgcatttttatcaaaaatgctgattttagcgttttccgcttctatttcgctcatcgtacctatattttcaggtctcagaaataaattaacgcctcccgcaatagccatgctgcattcttcatttttaagtgcctcacaagcaagatgaaccgaaacgagtccggaagagcaggctgtatcaacaaccaagcttggccctttcagattaaaaatgtaggaggtcctgcttgccaatatgccgggataagtacctgtcattgcaatcatatccgcatcctttactagggaagcataggaaaacttcaagtcaccgctatgatcatgtccaacgaaaatacctgtattcgaaccttgtaacttgttccccgcataaccggagtcctcaatagcgtgataaactgtctccaaaaacaatctttgtttcggatccataagcatggcttctcttggcgaaattctgaaaaatgatgaatcaaacttatcaatttcatctaagaatcccgctctaaaataagaattctcattcgcactgggcagcaatggatcaatatctttccgccgcttctccggtaagtcccggatgcatgaggcacggttcataatgttttgccagtattcttttgcattattggcttttgagaaacggcaggatatgccgataatggcaatatcacattgatttttcttggacttatcagataatccttttaaaatgcgcaaagccatttccctgtccattttttgctcttttacttgctccaatacatattgttttataatcgaaatatcatccacgattaatcacccctatcgattttgattctatataaaatatgagaagcatcatggatatatagaatagctgcttcaattgaagcagcttattgaattagttaatttttgtctcaaaaacctttccatcttctttacataacacctgcaccagatttctggcctgtaagacaacactcggaagacctcctcccacttgactccaatgcccaaccatataaaagtctttaagtccgggaagtgaacgtttcagttttttctcgtgcatgatgccttccatctgtttttcccagccctgccagcttccatttctattatttgtgtatcttctgatcgtatatggggtggatacatcagtcacgtcaatatttgatttaatttcaccaaaccatttgtctaattcatcaatcattacattcgcaattgcttttttctcttcttcatatttttcgcggttgtttttttgcaaagtctcccagtattcagcagaagttttcgcatacacgataatactcgttttgccatcaggcgcgaatgaaggattttcgttatatattttcacaaatatgtttttaacgttgtcacagccataggcattaagaggctgttctaattccagactcaaataatgaggatatttttcaaacgtttttgatacgcccaatccgacataaatttgcggtgcacttgttttaaggttgtcataacaaaatgtcagttcatcatctgtatattttccatccagcatttcaaaaatagttttatagccatccgctgctgaaatgacgatatctccataatgacactgtccgtttttcagctctattccgatcgctttatcattttctactaaaaccttagaaacaggtgatttatattgaatctcaccgcctaattcaacatatctggcttcaataatttttgcgaattgcagagaaccttctacaggatgtcctgaagatttgctattagcccagcctaaagtagccataaagtaagatataggggtatctacattaaaccaaaacagacgatttacattttctcttacaaaactgcttttaaagcgctgggcgaattctttgatcgtcacttttccccattgccccattactttcatgtaagggccagcctttgctttgaaggcctcaaagtctgctaaatcgaacagttcgggcgctttatccaaatccagctctacatcagaaacaactcgaatgccatcagttaaaagcttaattgtttccgcatcttcaggtgcaactcttaaaaactcctgttctaatttatctacatcagcatacagcgtaaatgtatcaccatttctaaagttaacaaccgcaaattcttcatcattaatgaattccatattttgtattacattcagttctttccaaaatttatggaaggtattgttaggtcctgaaccgaccagccagctgatacaaccgtcaaaaaagtacccttttctcttccagccggtacataaaccacccggcagcaagcccatttcaaaaattttcgtgctgtatccgttcatttgcaagtaacagcccgcggccattcctgcaataccgcctccgattatgattgcagtcttgttttcttctgtattcttcattaattttccccttttccgaaactagttttctagaattttcaatccttcttgtatattgattttgccgttctccaggtcgtcaaatagattgttgagttcttgctcaagccgattttcagcagtatcttcttccgtttcttgctgatgatctttattcagctgcttgtcaatatactctgatagctccactacagaggaatatgtaaatatatcggatatatccacaatgtcaggatattgttgatttatcagttttaacagttgggttgccataatagaatcgccgcccatggcactaaagctttcatataaatccagctcttgcatatccaaaaccatagagtacatttgcgcaatacttttttcggtatcagagtaaagttctccctttcctttcagcactatatcttcagtatctgttcttcgacgtttttctgcttcgttttttgtcctgtttttatctattaatttgtttttgatttgctcagataattcaaaagacaattcatccttcgcaaaagcgaggagcttcatatttaatgtacctggaatgatattagtaagcttattcgatgctatttcttctaaaacggaaatagccctttctaccgtcaataatctgaaaatagagctctcatcagtaattccataatcgacagctatgccgacctcatcccaagccggccagttaattgacagcgtgtttttcccctgtttgttttgcatataagcaaaggaatctaaataagcatttgcagctgtataatctccctgtccggcacctccgaaaatagaattaattgaggagaacaaaatcgtgaaatctaaatctacgtctctcgttaaatgattgataacccatgttccattaattttaggagcgagcacttctttaaaaatattagcttcttttctaaagaggaaaccgtccccggcaactccggcacaatggaacacgccattgatcgtaccgtatttctgttttatttcttcaattaccggctccatgctgtttaagtcagaaacttcacagctgtagcaatcaactttagaacccattgactcgatagctctgatggacttcagttttctgcaaagctttaaatccgttccatcagcaatgatatcgtcccatcggctttgatcaggcagtttagagcgattgagcaatacagcattgacgttatgttttccagccaggtgctttgcgatctccaaaccgattccgccggtgccgccggtaatcatatagacaccgttttctttaatctccataccgccgtgtttcttatcctttatcggttcaaccgtatccaaccgactgatataccgcttaccatccctaaaggcgacttgatagtgtttcccttttgttcttaactcctcactaataatttccggtgaagtatgttcatcaatatcaattgctttacatgaaacattttggaactcctgcgaaataacacgtcccagaccaaacaacgcggcgcccaatggattgattgtattttcttctccggacacttctgtcacaagatcagaaataagatgcaaattaatattgcttttcatcttattcttacttaatccccggactaagcggaacaggctgtatacgcctttattctgcatgtcttctaaatctgttaatgattccgttccttggcggctgatagaagacatatgtataatgctgctgatattttgatcgtttatgctatgcaataattgaacatagtcttcttctgatccgctaattaggaatttccgcccatttatcttctgaaattcatccccaaactccacttcaataacatcatcgtcatgaattttcaactgttccagtatagatttataaatttccatgttgtctttaaataacagtataggacctgttacctctgttttttcttcttcaaaagcttcttgcgccatccattttaattgataaagtgattcagaactttcttcaaaaagggcattaatccgatttactttttttaatacataatcggtgatttctgcaaaaacatttccttctgtatctattaactgaatatcacacagctttgtctctttactgcttgcgttctttttgacaaatgcataaaaatgctgcggcattcttgagtaaatcttcacgcttttatatgaaaaaggaaggaatgtactatcgtcatcatcttctccaataaacacgttcactgcattatctagcaaagcgggatgtaaaaagacgtcttttaaatctgctgtaaattcatcagccaattttaattcggccaattgttcatcagggcccagtatgacttctttgaagttcagccacctcggtccgaaagtaaagactttgctgattaaaccatttttattttcataattgacttttatcttctctctattactgtcattcctaacagagtctaaatcaaacattgatacagagtctgttaatggaaacgcttttccttctgcatgtgtaatccaggtttctccttcctgactggctattataaattgaatacattctttctttttcttaatgattgtgtgtacaatcttattctcatcctcatttaccgttaacggagtgaagaagataatatctcgtaattctaattgattgcttttatagtaagcggcacttgctcttcttcccatttcgatataagtcgttcccggaataacgcaagcccccatgattttatggtcacttaaaacccaatccttattcacattaaatgtcgttgaatagatcgtctcattcattgaatcagccaaacactggtcaatcagcgggtgactgatatttttctgatgcggcgcttgacctcttctgtcctttacttctccccagcataatgttctttcaaattggtatgtcggaagactgacaatctttctgcgctcatccttgtacatttttgtccattctacttttgctcctctgacatacaggttgcaaatttccgtaaggtttagcagtaaatattcatccccttcagtaagaatgtcatgtatcaaattgtcagattgagcattcattttgcgatgttcagataaggaaatttctccttcatccataatctgttttctatcagaaccaactttatggaaagaaaaatatacgcctttttctgatatttcattcaggttatgtcctgcaagcctgccgatttttctctttaattcttcgtaactttttacaatcagagccaatcggtagccgtaatggccccgccctgtgtttgctgtatagcaaatatgttttacgtttttttgagttccttttttaaagaattcattatattccttgatgagtttcattaaagaattctctgttttagctgataaagtaaatatctcaaatgtttcatttgcaggaatgacctcttcaacctcatctccagcatcttcaatcactacatgtgaattggtccccacaaagccgaaagaactgattcccgctctcctcggtgagttatttttaggccattcatgggctttgtctgtaacaaatacaggtgacttcacaaagttaatcaatgaattcggttctttaaaattaatactcggagggatgacttgatgcttcatagacagaacgatcttgataagtgacgccaaacccgaaacggcaacggtatggccaatattagatttaacagatccgatcccgcaaaactgcagcttgtccgtatattttgaaaacgcattggaaatcccctttatttcaattggatctccaagctttgtgcctgtaccgtgcgcttcgatatattgaatggtttcgggatcaatttgagcattttcccatgcctgaaccagtacttcttcctgggcgatggcatttggagctgtcaatccatttgaggccccgtcattattaactgcactccctttgataacagcataaatatgatctccgtcctgcttggctttacttaaaggttttaagatgactgcagctactccgtcactgaaaaatgtcccgtctgcgtctttatcaaatgagtgtactttatcacttactgattccatcattgattttttggacgttttgaagcgcggaaagaatcctaatgaaattccgctgacaatagacatatcgcattctttatttttcaaagcattacaggcaagatgcacaccaagcagccccgagctgcaagcagaatccaaaaccatagaacttccttttaaatttaataaataattaatccgccccgccatcaaacccggccagttgcccgtcatacttgtcgattctgattctgtaatgtagcggtacaacgtattattgacatggtcttttccaacaaagagcgatgtgttgcttccataaattttgtcccctgcataccctgcatcttcaatcgcagtccataccgtctccagcaatactctgtgagacgggtcaatggcctttgcttctttaggagaaatattaaaaaattcaggatcgaacttgtctacgtcttctaaatatccgccaggtttccagttatctgcttgttcttccgtcagatatcctgaaccgagaaaatcagtaaaccctttattgtttacgatcggtttaatgtaattgatcatatcttttggatattccgctttgcagtcttctccattcatcagattctgccagtattcatctgtattgtttgctttcggcagtctgcaggaaattccaatgatagcaatatcttcattgctgcttgcagcctttaattcttttagcattcgctttgcttctttctggcttagcttatgctgtttcacttgttcaaatatataagattgaacgctattcattacggatcactcccgctttctttctagaaaaatttttgataggaagggtaataagatctacatttttaccttaaaatggaattcagttcccgtaataatgtgataggcaggctgctttttcttcattcaattcgcagcctgccaatatccattttgcgaatatattcttacaggcccaattcagttattttcggtctggatgaaatatttgatttgcttcgctgacttccatctctccggatgccagcttattcaaaattgcatccaggtcatcttcattgtcttcttcagggattcggtcagaagacttctgatcactgaagtgggattcaaggtaggttgacatctccttaatggagggatacgtaaaaatatcagaaacatcaatgagagaaggccattctttctctatttcttttaccagatatatcgcggatattgaatctccgcccaaatcataaaatttatcagttatactgatttgttctaagcctaaaacttttatccaagctttcattagtttattttcaatatcgctgaagctaaatgtctgatcggttttcgattcaacagatttttttacaatcgcctgctccttaaaagtcaaaatatccggagataatcggaaatgaatttgatcttgatttaattccagtacccgatgatcaatttccccgatgatcacattccggatgtccttttgcatgacttcatcgaaggcacgtatcgcttcagctgaggtaatcgtcttaaagccgttttcatctttatgttcgtttccggccttttgacgctcttcaatatattcggcaagcatgcccacatcagaccagccgcaccaattaatcgtaactgttttttcatccggtcttcttcgctgtctgcgttctgcaaaggaatccaggtaggcattagccgcagtataatcagcctgccccatactccccgcaagtgctgtgatagaagaaaacattatgaagaaatccagatgctcatgctttgtcagctcgtttaatatccatgttccattaactttcggtctgagcacgttatcaaacacttttttttcctttctgaaaataaacccatctccagaaacaccagcactatgtatgacaccgtggattgtattgtatttactctttatttcctcgaatacatgaatcatttcactttcatttgcgacatccgccttatagtaatctaccttagaaccgctttcttttatttcttttagagcatcgattttcttgttgtttcccttctccatgttgatctgctgctcggagcgtccaatgaggattaattggacattttcttttgatgataaatacttggccatttctaatcccagtccgcccataccgccggtaataacatatacaccgttctttctgatgcttattttcccttcccgaattacggataagtcttcagtctggagctcttgaacgtatttatgccggtctctgtaagcgacaagctctgactgtttttttgagttgatttcaaacaagatgctttccgccataagattttgatccaaatctatgcatctgacacttacacgcgaatattccttttcaattacttttccaaaaccgaaaaatgccgcgttatgcgggttaatgtctggttcttcaccgcttacttgatgtgcaaggtctgcaaacagcatcagttctatgttattttttgtattttctacaagtgattttgttaaataaaataaactgtctacccctgaggatatttttttctgaagctgatatatgtttttgtctttctcattgctgatagacatcaaatggacaatctgagaaaccttttcactttgaagagcttttacaagacagtcataatcttcttgagcatcactgacagtataatgatggcttccgattttagagaaatagtcaccctgttccgcgacaatcacagttttcccttccagttctaaccttcgaatgatttcctcggataaactgcagccattattcttaaataataaaataggatgatgaatttctcgcatctcgtgtgattgatcgctttctcttatccaagatagcttatgatatatattgtttcttttagtcttttcagctgctttatgcaccctttttacgatgtaattgttgatttcaccgaaaacttctccagtgtcattcagcaggacgatgcgaaacgttcctgtttccccgttgcttcggctctttttcttgatataactgtaaaactttttagaagcagagccataaatcttaaattctttataaaaataagggagataggtttcgttatctattgtgaatgtcccggcattaacggcacaatccatcatcgcaggatgaagcgaaaactgaacgaaatcactctcatattctttcggcaattccaattcacatagaagcctgtcgtcgtctctgtagattgcgttggtgcatttccatctgcctccgacttgaacgatgctttccggtctattggtatcttctatatgataaaccgacttgtattcatcggtgtttatttccgtcaatggatgattattacgttgaatgacataaacagaattaaagcttttctttaaatcctcaatgtcatatgtttcccgtaccggttcttctttcgcaatgaccgcttccgcgtgttttatccatttatcgccggtcttacttatcacactaaactctaaaacgctgtcctttttctttatgatcgtatgaacttctttaacttcatttgcttttacctttaactgatttgaaaacgtaacgtcttttaacagaatgccgacaggttcgccgaagtattttcttcccgcttctctagctgtttctatataaaccgttccagggataacgtaagaatcattcactttatgttcatttaaaaaccaataatcagtgacattcaaatgggatatatacacttccagattcagtgactgcactgcaagattgctcaataaagattgttttttctcatcggctgaagggccgtctgcagccagctcagcccataatctttttccgctgaatttgtatgtcggcaagctgaccttttgaaaattcatctcgctataaagatcttcaaagttaatattcgccccatcacaatacatttcacttaaaatatgtaagtcagaggttggaatattagagacgtcttgtctgactctttgaatcacattttttattgtttgagtattctgcacactgtctgtatgcgtttttcctataaactttgtttgatttgttatcgattgaaagtatatatttttctcccgatacgttttccattcagagcatgataaaaactccagcttttccagcagttccgcgacagagcttattaccatagcgagtctgtatttgtttggcaatctcccagtgtttgctgtataacatatatctcccagattcacatctgtttctctctttaaataatcaatatgatctgtaagcaagtgcgcgagagatgttttagtcctagctgatacagtaaaaatatgttcagataaaacggattgatcgactttttcaactgcgggtgcctcttctaaaatgacatgacagtttgtaccgctcagcccaaaactgctgatgccgcacctgtatactccgctgctctcccatgctgaaacggagtcattgacgtaaacaggcgattcatgaaaattgatatttcggttcggcactttaaaatgtaaacttggcggaatttttttatgctttaatgccattaccgctttaattaaacccgctattcccgccaaactatcaagatgcccgatgtttgttttgactgaagatacggcacagaactgttttcggtctgtatattttctgaaagcccgttgcaacgcatttatttcaatcggatcccctaatttggtccctgtcccatgagcttcaatatatgtaattgttttaggatctatttttgcatttttccacgcatctactattacttgttcttgagctgctgcgttaggagcggtaattcctactgagctgccgtcctgattaacagcgctccccttaatgactgcatagatctggtcatgatcacgaatcgcttgggccagcggcttcagcaatacggcagcgactccttcgccgctattcgtgccgtcagcagaatcatcgaaagtccttacagcaaaatcagatgaagaattcccgatatttaacctgctctcctctattgtctttgggaatacttttatattcactccgccggctaatgccatatcgcaatccttatttcttattgcctgacaagccgtatggagggcgacaagcgatgaagagcatgcagtatcgattaccattgctggccctttaaaatccaagatatatgacagtctgcttgcgataactgatttaatgttacccgcggtagccagtccgagtaatgattgatctcctttttcaagcaatctgaagtattcatttgagccgtcactgctgagtccaatgtatactcccgtatttgtcccacataattttccgccgccgtaacccccgtcttccaatgcgttccaggccgtttcaataaataatctttgtctgggatcaatcaactttgcttcatttggaaggatactgaaaaagtcacaatcaaatttatcaatctcatccatataggctatttttgtataggctgcatctttactgtacttggttccgctgttttttaatgactggtcagcatctttttttctgttcagaggaatgtctctgatgaactcttttccttgtaaaagtaaatcccaatattcatttacgtgattggcttcgccgattctgcatgataaaccgacaatggcaatgtcatctccggaaatgtctttggtcccttcctcgtttttttgtttctttacattaggagtttgatttgtaaaagcggccgcttttaagttacttaaacttataaagtctgttttcatttttttacctcgctgagaatcactagataggtgatcatacctgtcaaacttcaaagtcttcaaagtgtttttttgtgtttgtttcagaaaataattgattaaatctttttttctgttcatttataggggttttttttgttcgaaacactgacttcagcatttctactgccatatgcatttgttctcttgacggctgacgacctgatgtttcaagttcagcctgtatggcagctactttttcatatggttcgattacacctttggcgtattcctcattgttccagttgtaatttttagtagcaaccgcgatccctaaacttctcgagataatagaaaaaccggcttgcagtgaaacagattcgttcaaaagagtctcttttataatcttcacgtcctcttctttgtcgtagctgtacgatttgatgtcagcgatattgtttcttacaagattccttaatacagatttcggcccaaattcaatcacagtatcagtatgatttgcttctaaatacttcatgattcccatccaatttaccggttttacgatttgagttcccagtatgtcagccatttgctgtttatctgaatatggaagagccgtcacattagataaaactttgtattttggagttctgagatcatacttttttaactcatggctgaatttttccgcagcaaaacccatgatcggagaatgaaaagcagcacttacatttaatttaaaaatgtctgctcctctggctttaagagtttcactaagctcttcaactgctgccgcttctccggataccacaacatctttatatccattgtggttagaaacagcaatcgtttttcctcttgaagagagagattcgcactcttcttctgctattctttcatccaggttcctgataacagccattgctccggtcccctgttcggcagcttctttcattaataatcctctggctctcaccagctttacagcgtcctggaaatccaaaacgtcactgcaaaccaaggcagaatattctcctaaactatggccggcgatatattcaggttcttttccgacctcttccatgtagattctgaattgtgcaatacttgttgccaggatggccggctgagtattttctgtttgagatagctcagcggcacttccatctatacataatttcttcaggtcaaatcccaatgcatcactggcttcgtcatacgtttttttagcgataataaaattgtcacataaacgtttgcccattcctgcatattgagatccttgtcctgaaaataaaaaacctattttcgacatttaaatacctccaaagtccctataatgcctgatttgccttacattctgccgatcagcaaaatgtaaggcagaaccggccgctttatattgaattgtctgctttgtctgctgtaatcacttgaatcaaattcatgtagttataaaataaatctttcattttgtgctcatttagtttctgatggttatatataaaaacgatttctgcttcggatggcttttcatgaactgcaaaaaccagatcatataattctgagtactctttttttgattcattactaatataaaaaagaggaaaaacatcttgggccgaacttgatttcttatagtgagtattcaaatcgtattgtgaatcctcttgattctcaatctgctccttcgccatacgaataatatcgtgaaaattctcgatatcagacagatcaaaagacagctgactcatccgatcatctccatgacccgaaaattggatatgaaccaagttttgctggctgacatcagctaataaaaatacataacccgctaataaaacatgagaaatatcatatttgtaggtattgcatattgtttttaaaccatcataataattcgcatttaccgcatattcgtgcatggctgtatgactttgtccagttgattccaagatgtattcaagcggtaaagtaataggaatgatttctttttccaaggacactgctatctccgcaaaggctatagctgattctatatattcggacaatctataaatagtcggatatgcaaacaagtcagcaatttgaatttgttttggatacagcttctgaagctcattataaactgcaacgattttgattgaattaccgcctgcttcaaagaagttatcatgtattccaggctcttctatttttaaaacatcggtccaaacacggctgatacttttttgtacatccgttaccgcttcctcaaaaggccggtcaaaacctgttctatctataacaggttcaggcagtgccaggacatttatttttccgtttgctgtcagcggaatttggtcaattttcataaagatctgcggaatcatatactcaggaagcacaggtgataataacttaataaattctgaaggatatacagtgctttctgccacataatacagaactaaatcttggactcctgcggaatttgtttttccggcagctacacattccttaactttttcatgttggtttactatgctttcaatctctcccaattctatccgataccctctgatctttacctgattgtccattcttccgataacgtccagttcaccatttggcagccaccttgctaaatctcctgtcttatacatcttggttcctttaacaaacggattgtctacaaacttttgcgcagtcaaatcttcttttcctaaatatcctctggccattccggctccagcaatgcataattcgccagtactgccgagcggtacagtgtttccatcatgatctactatatatatctgtgtattcgcaatcggcttccctatatttacactattttcattggttaagtctttcacagaagaccaaatcgtcgtctcagtcggaccgtacatattatagatcttcagatttttatatttttttagctcaaataacaattcccgttgaaatacctcgcccccaaccatgatggtcttcaatttctgaagactctccgtgctgttttctgcacttagcatcagctttaatctggatggcgtaagctgaatagtattgacatcagtctcaacaacgatcttgtttaacaagtacggatctctttgttccgcttcaccggctatgacaactttcagcccttgagttaaaggcagcagcgactctaatccgaatatgtcaaatgagcacgtggtgaccgaaagaaggacattgtcttgtgaaaagctgatcctgtctgttattcccttaataaagttatgaacggcacggtgctctacggcgacccctttcggttttccggttgatcccgacgtataaatgacatatgctaaatcttcggccctgttaataacatcaatgttcgtctccaactgatgtaataaatcctctgaatctatgttaaatatggttccgctgtacgttaattcatttggaagtccttcttcagttaacagcaggccgcttttactgtctttcagcatataattgatcctgtctgccggataatcaggatcaagcggtaagtagcatccccctgcctttagtattcctaatattcctataatcaatcggaaagaccttcttaccaaaataggaaccacaacattctctttgatgccattttccctgagggctcttgccaattgatttgccttattattcagctccttataggtcaagaagtctccgttccattccagagcgattgcatcaggtgtccttaaagcttgctcttcgaagagctcttgtaacgtcttttctttcttatatgataattccgtgcagttgaattctttcaccagcttttgtttctctgtctcatttaccatatcgatctgagaaactattacttcatgatcagccgctgcctgctgtaagatgctaaccaggttatctaagattgaacttaccgtttctttactgtaaacactggcgttatatgtgattttcatatgcaagtcgtcaccgggagcaattaaaagctctaaatcatagttggtttgttcaaacccatgttcagcagttatttttacactcgaacgggctgaatcttggaaaagatcctcactcaacgggtaattttcatacacgactacgtgattgattaatttattcttcatacttgtcaaagactgtatgtctgccagagaacaataactgtattcgttcgcttcaataaagtctttatttatttgtttagccaatgaaataaatgatgtatcacattctcttttcactctgattggcactgcatttataaataagccgaccatattttcaattccgtttatctcactcggtctgcctgaaacaatggaaccaaataccacatcatttgtattgttatatttctgaagcaatatcccccatgctgtttgaacgatagaatttaatgtaatgctgtttgactcagcgatttttttcagcttagcggcggtttcaccgttaagcgctcccagtttttgatcatgctgatactcgtcagatttcaattccagttccggaaatgagatctcttgttcatatgcagaaagatattccttccaatattcaaatgcacggtccttgtcctgctgatcaagccattcaagataacgactgtacggtacaggtgattcttgaaggagttttttcccttcagccacgtcaccatatagatccataagctcttttaacaggataccgacactccagccatccaaaataatgtggtggaaactgtatatgactttaaatttatttcttcccagcttgatcaccgatactctgatcagacaatctttgttcagatcaaacggagtattcctgtctctcaccttgaattgccctacaaaggcatccttcttctgctcctcccattggctgatatcatgatattgaatgtttagttttctttcttttaaaatggcttgtttaaatacacggaaaccgttatagaaaaatgacgttcttaatatttcatatttagcaatcagcctgtttaatgcgtcactgagaacttctgtattcagatttccttcaactgttatttcactttgttcgaaataagcgctagattgatggtcaatcacagcgttatacagcatgccttcctgcatcggtgaaagagaatgaattttttctacttcagcaccgcttgcaagaatttgatttagctcctctatttgaagatcgggatccccataatcccatggagttttctcagatattttcttattcacacaatgttctatgatctgatttattttcaattgataggctttcgtaaattgctcaatcgtctctcgtttatattggtttgcactgtaattgaacgtaaacatcagcctgccatccatgatatatccatttatttctatactatgtgtctttttatttcttccagatatgctcgttccggcggacaaaggtgatatttgaaataggttgctgcgatcttcttggccaaattcacccaagtagttaaaactgatatcaggttttaattgaagatgaaccgagtccgacaaatatctgagtattccgtaaccaatcccgttatgggggatatgtctaagcatttcctttgtatacttaatggagcttgataaactattactttccgtcatatcgagaacaattgggtatattgtcgtaaaccaacctattgtgcgatggaccggggtttttataacactttcacggccgtgcccttcaagattcacaaggatcttctcgttgccggtccattctttggctgcaagtcccagtgagcaaagcaatatatcattaatttgtgtatgatatgctgcatttgtatttcttaaaagtgtttttgtttgatcctctgttaattcaattttaatttctttactatcttcataagagcagctttcggcaatgaaatcctttggaagaggttcaataatagccgtttctatggtctcccagtacccagcttccttttgaagagccttgctgtttgcatattctttcaattgacgcgcccattctttgaacgatgctgttttagtttccagctccaccttgttcccattaactgtttgaagataagctgtttcaaaatcttccaataggattctccaagatactccgtcaatgatcatatgatgaatggttaatagaagatgatctccgtttttggttttaaataccgccagttttattaaaatccccttttccaagctcaattcgttctgcatacggtcagccagtgattcaattgccatggctggatcttctgtttgtgtcatatcaaatacttctaaagtaaatgtttcttttgcctgtttaatgcccctattccattgcttaatttcaccgttttcctttttaaactgcatcctgagggcatcatgatgcctcaccagttccaaaaaggccgtttcgattgctttttcttctatgccggactttttgtaaagcataaaggcttggttatagtggttttcttgttcaaatctctgttctataaaccacttttgaatcggtgtcagatcaacgtctccttctacaatcgactgatctgcttgtatatcagctgattttacgtgagcactcaagtcttttatgtgcggatatttcattaaatctctgacttcaagttttaagccgtatttttggagttcggaaactactaaaatggatttaattgagtctccgccgatctcgtaatagttatagttaatcccgattgatttcatccccagaactttctcccatacgcatgcgagaatttgttcctttttatttcgcggtgcttcatatgcagactccaatacatccgcaatatctataatcggcaatgatttcgtatctatttttccgtttgaacttaacggcattttttcaatctggaagatataacttggcaccatatataacggtaattctttagacagattttcttttaaagcataaacatctatttttttgtcggaagtaacataaccgcagagatatttatccccatgttggtcatctctcgctacaacaacagcctctcttatgtgactcattttcagaagccggttttctatttctcccgtttcaatacgatatcctctgattttgacttgatcatcaattcttcctaaataatcaattgtcccgtccggcatccattttgccatatcccctgttctgtataacttagccccgggttcaaaggggttatctacaaatttttctgacgttaagcccgctttatttttatatccgtctgcaagcccttctccgctgacacaaagttccccggctgcccctaaaggaagtaattccaattgttttcctaatatataaagcttagtattatccgcaggtttgcctattgatactgcattgccattgtctctttcaatatgatattgatgaatcatacacccgactgtagcctctgtcgggccgtattcattgtagattttgacatgaccgttaaatgcaccgtgtatcttttttgcaagcccggttttcagctcttccccgccgacgattattttttttatctttgacgtacttaaatctacattctccagcaatctcaaatgcgtcggcgttagcttaataatatccgctttattttcttctataattcttctgatcagaagagccttgtccggtccctcataaataataattttatttcctgaaataagcggtgtataaattgaagtaaccgttaagtcaaaagaaatagaagaatacagaggaaaatcaatatcttcatcatttacatatatcttatttgcccaatgaatataatttaccacgcctttatgttttaccatgacgcccttcggcagccctgtagtccctgaagtataaatcatgtaggcaaggtcttccgggcaactgacattcggcagattacttctgttatgcatatatagagcaggatcacttaatgataaaatttctttattgaatgtaataccacctgacaatccgttttgaattaggagaatgtttgcatcactgtctttcagcatgtaatttactctttcatcaggatattcaggatctatcggcaaatacgctccccctgctttcagcaccccgataattccgatgatcatctcaagagatctctctgtcatgattccgacaatgctgttttctctaattcctttttgtctcaaaagattagccaggctgtttgatttctcgtttagttctttataggttaatagcgtatcttcttggacagccgcaatacgttcaggtgttttttctgcctgctcttcaaataattgatgaatcgttttattccgaggaaattcagctgccgtgtcattgaatatatggagcaatgtgtgcttctcctgttcaggaatcaaatccagtttcattaaaggttgatctaggccggcagctgcactttgtaaaagcttcgtaaaatgggcacccattctctcggctgtttctttttcaaataattgactggagtattccaagtggaacttgattcctttatcaatttccgtcgcggttaacgttaaatcgaattttgaaatattgatctcggtttgaatatgctcttccggatttggatccaagtgattttcaataccgtaatctgcattttcaagtacaaacatgacatcaaacagcgg

SEQ ID NO: 135 - DNA, 32115 bp, Bacillus velezensis FL50S
taaccgcttgaccaacgggccgtctggttgagaacttatctggcggagaaggagggatttgaaccctcgcgccgcttacgcgacctacacccttagcaggggcgcctcttcagccacttgagtacttctccataatggctccacaggcaggattcgaacctgcgaccgatcggttaacagccgatagctctaccactgagctactgtggaatgatcagactttctttattataaatgatgcgacatattgtgtcaataagcaacatttatttttttgagaaagcatcgttgtctctcaacgacttttataatttaacacagatcattgaaatgagtcaagcctttttaaaaaattcttttgatttttcctctgcactttccgcaggcatatctttccggattcattgcccgcttctttatatactgttggccgcaagcctcgcatctatacatatatgttttcttttgtgtctttttggtttgcagcggcgtgcagaatcttggcgctccgactttctgaagcaggtctctgaagtctttgtctctgtgcttgtacccttttccctcaagatgaagatgataatggcacagctcgtgtttgatgatgcctatcagctcgctctgcccgtgttcgagaagatatttgcggtttaattcgatgttatgggaagacagcatgtagcggccgcctgtcgttttcagccgatcattgaaaaaggcccggtgacggaacggctttccgaaatcttttgcagagatgtcttccgtcagcttttgaagttgttcgttatccatatgtgcaccccgctttaaaaacattgaacgggacaattcaccgttcgcatacaatgtgttaaaaccgacctctaactaaaagctgaggaggaatgagccatgccgaattggctgatgaaacaaatgcaaaaagcgtttttagaaaaggacaattaccaaatcaaactgctgaaccagtgctggtatttctacagaaaaaaacactgctcgtaagcagtgcttttattttaccatagacagcgacactctgcctttttgcacgtccaccccttcaacccatacggtgacgatgtctccgaccgatacgacgtcgagagggtgtttgacgaattgattgctcagttttgagatgtgcacaagcccgtcctgcttgacgccgatatcgacgaaagcgccgaagtccacaacgttccggacggtgccctgcaattccattccttcctttaaatcctcaagctgcagaacgtcttttttcagcaagggcttcggcacttcgtcacggggatcccgctccggccttgtcagctgcccgcaaatatccgcaagcgtaatctcccctataccgagctcttcagccgtttcagacagcggcaatgcacttattttctctttgacgtccgcgcttccgatctgatccgcagtgagctgcagttttttgagcagcgcctttgtctctttatagctttccgggtgtatcccggtgcggtcgagcggctcccgtcctccgggcactctcaaaaagccgatgcactgttcatatgtttttgcgccgagacgcgggatatctttcagctctttgcggtttgtaaattttccgagctcttccctttttttgacgatattgccggcaacggttttggataatccggctacatattgaagcagcgcggctgatgctgtattgacattcacccccacttggttgacgacggtctctacgacaaaacggagagattcgtttaaatgcttttggctgacatcatgctggtattgcccgacaccgacggatttaggatcaattttcacaagctcggccagcggatcctgcaatctccgcgcgatggagacggcgctgcgctcttcgacctgaaaatccggaaattcctcacgggcgatttctgacgcggaatacacgcttgctccggcctcattgacgatgacataataaatgtcccgctctgtttctttcagcacatcaacgacgaattgctctgtctcccgtgatgccgtgccgtttccgatcgccacaacctcgacttcgtaccggtccagcaattctttgatttttttccgggcttccgctgtctttttgacgggagcgtgcgggtaaatgacgtcgattttcagcacttttcccgtctcatcaacgactgcaagtttgcaccccgtacggaaggccggatcgacgccgagcacgacttttcccttcatcggcggctgcagcaggagcttacgcaggttttcagcgaaaatatggatcgcctgcgcgtctgctttttctgacagctctttgcggatatcgcgttcaatagccggctggatcaggcgtttataactgtcctcaatcgcttctttcagcgtttctttcacaggtgtttcacggtgtttgatgatttgcttttctaaataagcttttatctgatcggcgggcggttcgatcgcaacctttaaaatgccttctttttcaccgcggttcatcgcaagcactctgtgaggaacgaccttttggatcggctcttcgtactcgtagtacatttcatagacgtttttctcgtcatctgcggctgacttgcctgccgcggaagtgagaattccttttttatacgtttcctggcggatccactttctgaaatgaggatcatccgagatttgttcggctatgatgtgcttcgcgccttcaatggcttcctctcttgaagcgacttctttttctgcactgatatattgatcagcgacgtcgtgaaggcggttttctttcgggagagaaagaatatagtccgcaagcggttcaaggcctttgcttttggcgacggtggcttttgttttccgtttttgtttgaaggggcggtataaatcctcgacttcctgaagcttgaccgcttgctcgattttttgcttcagcccgtctgtcagcttgtcctgctcggagatcaatctgatgacttcttctttccgctgcgtcaggttttgtatgtattgccaccgctcggagattgcctgaatctgcacctcgtccattgagccggtctgctcttttcggtaccgcgcaataaacgggacggtattgccgtcttccagcaggcggatgacactttcgacatgtttttgggataacgctgtttcttcagcaatttgttttttcaaaagggctaacgtttccatatcacaaaagcctccatctcttctttctttctctagtgtatcaaaaaacggcggaacataaaaaaagcagccttacgataaaagctgcccgagaatataggtcaaatcatcacgtctggatgttgtgtacggatgaagtgattttgatatttcttctattgagtgtccctgctttaagcaggtgcggatatgcggaacctcaagcccatccgtgtagatgatgaatgtcgcccctttttcgtatgatgacgtatacgttttgtatctttgcggtttgcctgagaggtaacccgaaatcggcagcggatgaaaaacttcgcctgatggggagtgcaggaagaaacggacgttgccgatcgagcagtatgtcaattccctttttatgaaattgatttttaagatggaggcagtcgcccctcttttgtttttcatcgcttgattgcagcgctcaatgatgctttccacatcctcatccgcatacgtttccacgatgtctttaatggctgacgaggattcgttggcaagagatccgctgccgagaccgtccgctaccgcgcaaactaattcttcttcattcgccttcataaaaaagctgtcgccgcatatggacttgccttctttatttaattggtatacaagagtttgaacatgttcattttcttcaacctgaatcattacattagctccatggagggatctccaatcaaggcctctctcagttttttcaccgctttccgctgcaggcgcgagacgtgcatttgagatattccgagaatgtcccctgtttctttttggcttttattttgcacaaatgttagatcgataatctgtttttcgcggtcggacagcacatgaagcacgcttttgatcatcatctgctggttgacgcgttcgtatccttcctcctgcgacccgacgatatctaaaatcgtgacggtgcttccgtccgcatccgcttcgatgctgtgatcgacagaaagcgcctgatagctttttcccatctccatcgtttcaagcacttcctcttctgacacatcgagaaaggctgcgatttcttcgactttcggcgaccgctgcgtctctgtcgtcagctgatccaccgccattttaatgcgcggcccgagttctttaatccgtctcgggacgtgtacgctccatgttttatctctgaggaagcgtttgatctcgccgatgatggtcggaatcgcaaatgcttcaaaggatttgccgacctcgggatcataccgtttaatggctccgagaagtccgatcatcccgacttggcggagatcttcgtgaaagctttttccttttgaatatttctttgccagcatttcgacgagattggtatacacctcgacgagtgtttcctgggcttctttattatcatgtgtttgaaagtcgcgtatgagccgatcaacttcatctttagttagtttcgtagtttttgatggttgtgccatgatcaactcgctccccatttaaatactttgtcatcgccacggttacgccagagttgctttgaactttgacttcatccatgagcgtttccattaaatacagaccgagccctccttctgacaattgatcgactgtgtgcgaaggtgtgtacggcccgagatcctgctgcttctgatcaaaatcaaagctgtctccctgatcggcgacaatgacctccagccgatcctcaaacacaccgaaccgcacggatacttctcccttattttcatctttgtatgcatgctggacagcgtttgtacaagcttcgctgacagcgatttttaaatcttcaatgtcatcataggtatagcccattctgctggcgactcctgataatgtaagcctgacgattcctacatattccggttcggccggaattttcatctctatataatcaactgatgtactcattgcactccaccttctgactttgccgaaatgtcgatgatgtccttaagccccgtaatttcaaacagacggacgagccggtcggaaagattctcaagcttcagagagccgccttccttgctcaccgttttaaacacgcctacaaaaacgcctaaacccgtactgtccatatagtttacatcttttaagcagattctcatgtccttcccctcgtttgccaggggcatcagcttttcacgaaccaccggagctgagtatacatcgatttctccagcgatattgatttgtatatctgaaagattctccttcatatctaccgttaaattcatcgtatcacctctgaaagttatccttactcgtgctaatggctttttacccgtgctgccgtttttttaaacctttcttttcaaaacaattaacgtaaaatcgtcatgaagctgaaagtcctgaagtctcagcaggctgtcgtaaatatttttgaccatatcctgcgcggagcagtccatatgttcttccagcatgcgctgaatgtcgctgcgttctaagaaaccgttttcggtacggcattcggtgacgccgtcagaaaaaagaacgatcatgtctccttcgttcatgtgctgttcatattggctgtaatcaaaatcctgggaaattcccagcaccaatccttttgcctccagatcataaaactttttttctttttcagagtagtagaagcccggttcatgccccgcagaagcatatgtaaattggtgatttttcgtattgtagtttgcgtaaaacatggtgataaacatgcttgagtccacgttctgttctacaacgcggttaagatttttcagcacttgggaggggtgaatgccgatctccggaagagagtccatggcatacttgatcatcgacatgcacaatgcggcgggtattccttttccgatgacatcggctatcgcgatgttaatcgattccttgtctttgacaaagtgataatagtccccgctcatttgcttggcggggacgctgatcgccccgatatccagttcttcttcttcaggaatttttgtgcccagcagcgtctgctgaacatttgcggcaatttcaatttctgaacgaagctcctgctggatatctctcagactttggtgttcctgataagccatcccgtagccaatcatgacttctattaaaaaatccagcgaatgaaaaacatcttccggcagatccggatacagttcctttaccacttttcggtggatgctgatgatctcctccggaggaacctgatgttcaatcgtttttcggctgaatttttgggcttgatataaagatgtttctgttaattcggctatatatcggctaagcagctgatgataccgctgctctataacctccctgaaatccacgttctaacctcctaccgaagccattttacggcttgaatctctgttccttcctctgcaacagattgcaggctgaattcgtccatcagccttttgacgcccggaagtcccgctcccagtccgcctgacgttgaaaagccgtcttccatcactttacggatgtcggggattccgggtcctttgtcttctgctataattttaaggccttttttccctctgtcgtttacttgttctatgctgacctggcccttgcctgcatataagtaaatgtttctggccaattctgagatagccgtcgtgattctggcctggtccaccgtgccgaagcctaattccttcgcaacgttgcggccaagctgtctggcggctacgatatcccattctgtcatgattttcacacaggattggtcgttcatcgctattcccccaattcccgcttcaatgtctcaagcccttgctctaaatcgagcgccgtttcaatttcctcaagtgagattccgagttcaatcaatgtgaccgccacagccggctgaattcccgtcaatacgacctttgcgcccatcaatttagacatggtgatgacatcgccgagcactttcgcgataaatgaatcaatcatgtcaacggatgtcaggtcaatgacgaccccgtttgcgccggtttcatagattttgttcagcagatcttcttgaaaatgcaaagctgtctggtcgtcaagctcccattggatggataccaataagcagttatacagtttcaggatcgggatttttggatgtctcacaatgttattcccccaatgaaacgatttttcgatttgtcatttcaagcgctgtttgaattcctttttgaagggtattcttcgtaataacctgcgacaaatcaattcccagattaacgatcgtctgcgcgatttccggacggattccgacgagcagacatttcgcgccgacaagccgcaccgcttctgatgcctgaataatatggtgcgccaccatcgtatcaacgaccggcacgcccgtgatatcaattaatacaacctgtgaacggtgctttacgacgccgtttaacagattttccataatatgctttgcacgctccgtatcaatcgtcccgacaagcggcatgactgttacatgctcaaataccgggatcagcggagccgacaattcctgaagcgcgattttttgcaaagtaaccgttttttcccaggagatagaatactgatttaagatttccgtgttgatcggattgaaaaagctgtctatttccaaaatcaaatctgctctgtcctgatcggccatattaaggtcgaccatcgtttcgtaaagcagtttccaaaactctgacagggtggctgaaagaagtttcagcgacaggccgagctgaacggcgcgcagtgcgagttcactgatctgctcttccgtagcctcgtcatttttagtcgataataaaagaatgtctatataatctttacaaatattttcacatatgtgattcgtaagctgatagtcttcctgattgcctacttcttttagtttggctgtccaagtatcaagcagttcatcatgctgatcaataatgaactgatacactttctgattcgacatgggtttcactgacctcccgacacaaaacaacaaattttgtttgattatctctttattatagcgcttatgtttttcgaaaacaaaaaaagttgctctatatgagcaaccaaaatatgactaaaaatcaatgagtgccaaactgatttgcagggcttcatcaaccttatccatcatttcatcatccagatgagttattttatccgttaatctttgcttgtcaatcgtccgaatttgctccagcaaaataacggaatctctttcaaaaccgtagcgttttgcatcaatttcgacgtgggttggtaatttcgctttctgtatttgggctgttatggctgcaacaatagcagtcgggctaaagcgatttccgatatcattctggatcactaaaaccgggcgtacgccgccttgctctgagccaacaacaggagataaatcagcaaaataaacatcgccgcgctttacaatcaaaatgattatcctccgctgactaagcgctcaacggtcgtttctgcttcgcactcagcatagtgagcctcagaagagatattcaagttgattttcgccatttccatatacccgcgtctcatcaaatcacggttatggcgagttgtccgttcgctgacatacgctctcactgcttgtgatatcagttcgtttctgcttcgtttctcccgcatcgctacaccatccaattcagctactaagttttcgggcaagctgattttcatttcggttcttgcgctggattcagacaaaaaacatacacctccaccaaacttacggatacgaccaattcatccatccagacataatgataccattattcaaacgtcaagcaaagctgttttataaattctctttttccggatgacggctacttgtttgtattatcttgcagtaaaggatttcttacttccattatactctcattttccaaaaacatacggggaacgcgggaactaatggtacaagggacctcgtaattaatcgtctcaagccgccctgcgatttcatccatcgtgatcgtttcttccttctggctgccgatcagggtgactttggtgcccggcggataagagtgatctaattcgaccatcaattgatccatgcagattcttcccgcgatgttcatccgtttgccgccgatcagcacagacgtgccgctcagcttgcggagccacccgtctgcatagccgatgggaaccgttccaatccattgatccttctctgccgtatatgttgcgccgtagctgacgctttcccctttgcggatctttttcacatgggataacacagagtgcagcgcaaaagccggctttaattgaaacggaatttcgctttggatgtcagcagaaggacgaagcccgtacatactaatgccgaaacgaaccgcgttaaagaagccttttttaaggcgaagtccggcggcgctgttcgcgcagtgcaccatcaattcttttaaagggagcggagcgatcaatgttttaaagcggtcaaactggaagaggaaataatctctgtttttctcatccgcggtagcaaaatgggtgaatacgcctttacagactaaaccgggattttggctgaggatttttaacacgctttggatttcttcctccgttttgactccgagtctgttcatgccggtgtcgactttcagatgaaacggcaatgtcgcacttccgaggtggcgcgcagcttcctgaagccattcaacagaataccccgtgagtgttacgtcatactcggcagctgcttgtacatattcgggcggcacggcgccaagcacgagaatcggcgctgtaatgccccgttttctcaatgaaatcgcttcatccagtatggctacggcaagacaagaggcacccgcttcaagcgcggctttcccaacttccaaatctccgtggccgtaagcgttcgcctttacaaccgccatgagatggacgttttgcccgatgtgttttttcatatacgtgacattttctttaatcgcggacaggttgatttccgcccacgtttctctgtaaaaggatgctgtgttcattcgatacacttcctagcattattttcaattcatattgttattatcatactaaaattattctgcaaagtgaaatggaatcaaaaaagagaccgacagcggcggcctcttttttgacattattttgacgactgtccctgcatgcttttggcggcggccaccatttcatcctttgtcagatcctgtgatgacagaagataatccactccgtcatatgtccacgttaaagacgtatcagataatgcggccaccgtgaagccgagattaaccggttcgcctttcagcgtgacggcagaggcggcttttgcgatatgggctttttcttgaataagggtgaaggatttttctccgccgtaagtcatgacgatccgtttgccgtccgccgttgaaatatctttctcttcaagctttttgacgccggccggcacttgaagcggtgttttgaccgcaaatgaatcagacggcttggcgcttgtggcgacgtccatctgggaaagcgtcatatttttcttctcgtcaaaagagtctttatcaaacggcttgttgaattcaaagcttttgaattcgactttcaccatcactttccggtctgtatccatgactttgacgagcgaagggctcatgtcctttttgttgaaagtgatttcctgagtcggcagcattttgttgtgctgatagtttgtttttgtttcaaacgtgtactttttatctttggcggaatagacggcgtctttgtcatgctgcacgtcctttacaagtgactcaaacaaatatacttggctgctgttattcggccagtcgctttggaacctgaagctcttatttaaagacggcgtaaggacaaagactccgttggcgttccgtaaaatgacttggttttggtcttttttcggattttccagatagacccggtacagggaaggttttttatgccagatttccacattgtatacttgcggatcactccccgtctgaatggtcattttggctttcgctttgtacgaggtgtattctttcgccttcttatctaaaccgttcacgatatcttcctgtgatttttggccgcaggccgaaagaataaggacggcaagcagtcccgttaaaagcaaaacaaagctttttctcaccttttttcaaccccttcttctcaattgatgtaaagggaagaaatcgcttgtttgactttaacggtacgccctgaacggacggacgcgtaccataaaagcctcaaacaacttgtctcccttaatgcactatcaaatatatgaaggggtttcggctaatatgcagactagcgtgacaacctttcaatcacgacctgtgccgcggcgtattcttttgtatgggtaatggagacgtgaaccgccgcgccgtccagcttggcgcaggtcagcaccggcttgcccgccgtgtcgtttccggtttcgatatcctgaaagctgagctctttgccgatacccgttccgtatgctttcgaaaaggcttcttttgccgcaaatcttcccgcgagaaattcaattttccttttgtccgacagcaatgtaaaacggacgtattcagcctccgtcaatattctttgcggaaacctcgcctgccggctgagcatgttttcaattctgtgcagttcaacgatgtcgattccgattccgaaaatcatgtgaattcctcctaaaagtccgtactaaaaaacggtttatgtcataaacgtgttactatatatgtaacaaatcagatgcaaaggggcttgcgatgtttatacgtacggaaaatttccagacttttatcagacgttatccggccgtcagctgtatcttggcgctgcaggcgttcttgtggctgtttttcagtatgccgcttcattccgtcatgatgtggtcagatgcagtgaccggctataattacggcgtttcctcgggagaatggtggcggctggtgacaccgatgtttttacatgcgaatttcactcaccttttgtttaactccatgtctctctttttattcgcgcccccgctggagcagatgctcggaaaagtccgttttctgattgtgtacatcgcatcgggcattatcggcaatatcggcacatatcttgccgaaccgcttgattatgtgcatgtcggcgcatccggcgcgattttcggacttttcggcgtgtatgtgtttctgactgttttccgcaaggagctgatcggccgggaccagtcgaaaatgattatgaccctgcttatcatcgcggtactgtcgacgtttatcaattctaatattaacattatggcgcatttgttcggactggcaggcggatttttgctttcctttttatgcgtgcagcaaaaaaagcggcggtattaaccgtccgctttttcatatgaataccagcgcccgatgcgttctgcatcttcctcgctgacatccttcagcatgacatgctccatgtggtgagctgatttcactgcggtagccacggatgcgagccgccttcttttttgcagaaaggagcggctgacttcaaacatctgcattcttcttctcagcataatcgtggtcgtcttcccgatcagccgtgtggtgagctgcagcctgccgccgtttaagcaccatgacgcgctcttaaatgaggcgtagcccagcaccagttcgacgggaagcacaaggagcgatgcatacccccacggtttaaacagaatacaaagcggaatgatcacgaaaaccgagaagataacggagcggaataaataccggcgcagcgcccttttcggcaaatgattccggttttcttccagtacgtaatccggtgtgaaaccgttcagcatcacaacgagctttgatttgcggatgatcggaaacagaatcgtctgagctccttctttctcattccccgcacttccggcgctgacaatcgcaaccgtcgcgtatccgaataactgcctgattacattttctttaattttaatggcttggattttacggagcgggatggtcacttgatgtttttcaataattcctctcgtaatgaccaattcgtgttcctttttttctatcttaaagttggcatgcttgatcatcataccggcgatgcttaacagccaggcgatgaacaatcctatgaaaatgatcacggcgtatatgccgatgctcgcatgcttgagaaaagaaaacctgtcgtagagccagtccatcggaagtacttcatcaagctgagaaaagagggcgaataccgctgagatgatgacaccgatccccccggatgttgaggcggccataagcagctcacccacagacaggcggtaaacggattgcacatcttccccgcgcatcggctcctgctccgctgcggtctcccctcgttcttcttgctccgctttttgctgaaaaacagccgctctgatccgttccgcctcttccacagtaatggcggataagacagcctcggcgtttttcccgtcgccggccgtttcgatttgaagcttaacaagcttaaaaagctgctgaacgatgccggcactcgtattcattgattgaatccggtcaatggagatgtatctctttttcgtaaaaaacaagccttcttcaattctgaattctccgtcctcaatccggtatgtaaattttctccactcgatcacacttgccgtaatcagccagacaagcaggacagcgagcgcaatgcctccgtaaaagcggatgaagtggttggaattaacaatatagacgagaaaaaatggcagaataatgtttttaatggtttcgataataatatggaataagttcaaaatcacggccgccgggtgcagacgtttcggctcagacatcatcttccgtcacccttgccagacgggaaatggaatccctcagccggtcagcttcctccatatcaagcgccggaatggaatgaacggtagccgccgtagagattttgactgaggccaggcggtaccttctgaggagcgggccttgtgaagtatctacgtgctgcaccctcaccatcggcacaatgacccgtttgactataaaaatgccggattgaatatcaatttcattttcatggacctcatagcgccagatcctgtgcctgattttcggtatggcatagacggatatcactgaaccgatgatccaaatgataccgaggactccggtgatccaatacggccaatggaagaaatggcttaaaacagctgctgctataacggccagaagacagaaggcggacaggatgatttcctgaagacgccagacttttaagccgcttggactgattcgattttttggctgtgctctcaacatacctacctcccattttttatcatacatacaaatacggctgatttgcaaaaaagattcactttccggcatatcgaaaaaaagcggaccccgtaaaagggtccgcttcctgtgttttagtatgattttttctggcgtctgtcacctgaagaacggcggtcgcttgagcgttttttatcgtaggaagaacggttgttgtttttccctttgccgccgcggtagccgccgccttggccgtctctgcgcttagaagtacgctggtttttatagcgtttgctgaccatcggcgcttcatcagtgaggcgtacaggcgtgctgtccggctcttttgtcgccattttaatggctgcagccacaactgtcactgcatcatgatcttctaacaattccgcagctgccgtcatgtagaagttcaggttgttttcgctgatcgccgtgcgcagacggtcaaccgtcacctgctgctgaccttctaatgcttcgtcaagcgtcggctctttcatgcggtccattttgcgttttgtcgtttgttcgatcgcgcgaagcatgtttttctcacgcggtgtgataaacgtcatcgccatacccgtttttcctgcgcgtcccgttcttccgatacggtgaacgtaactttcaggatcttgaggcacgtcaaagttgtaaacgtgggtaacacctgagatatcaagtccgcgggcagcaacgtcagtcgctacaagcacttcgatcgcaccttctttaaacttacggagcgctaccatacgcttcgcctgcgttaagtcgccgtgaattccttcagccgcatatccgcgaaggttcagcgcttccgtcaattcgtcaacacggcgttttgtacggccgaatacgatcgcaagttccggagactgaatgtcaagaagacgagtcagcgtatcgaattttttgcgctcctgcacttccaagtagaactgctgaatgttggacacagtcatttctttcgcttttacttttacgtgttccggctcagtcatgaaacgctctgcgatccgtttgatcggcgcaggcattgttgctgagaataagagcgtttggtggtcgctcggcacgtttgagagaatggattcaatatcatcaatgaatcccatgttcagcatttcatcagcctcgtccatgacaaccgtgttcacgttgtttaaacggatcgtgcggcggttgatatggtcaagaagacgccccggcgtacctacgatgatatgcgggtttttcttcaatgcgcggatctgacgtccgatatcctgaccgccgtaaataggcagcactttcgcacgcttatcttgtccgattttatataactcttcagatacttgaatggctaattcacgggttggcgcgattacgattgcttgaatattaggagactcggggttcattttttcaacaaggggtataccgaacgcagctgttttacctgtacctgtttgcgcttgtccgatgacatctttatttaaaagtccgagcggaatcgtttgtgcctgaatcggtgttgcttcttcaaatcccatacgattgattgatttcatgagatcagaacttaattggaaatcttgaaacgttatagtcaaattattcaaactccttctgattgctgtttcagtaatgtcgtgatttaccactaaaaactgccctttcatccaaaggacaggatcatacgtatacaaagcccgaattactttacgtttaatcttaccattacactatgtgtttttcaataaggcgagatggtcaggcggccggaagcggcctgaccggattcttcccgcaaacgaggccggaccccgcgccggacgggatttcccagccggcggcctttctttttcatacggacagaattatttcaccctgaattagtttcttcatttttgtatatttttataatgctgatcagtattttttcagttcttctctaataaatctttaacgatttcttcgagcttcatacctctcgatgctttaaacagaaggagatcgccggaagcggccatatcctgtatggcgtgaagcagttcttttttgtcgagataatggctgacgcgcccttcttcaaaatgccggcgcgctccgtctgcgatgaatgcgccgagtgtgccgtaagtaaatacatggtcaatttccgccggattgatcgcagctccgcattcttcgtggaatgctttttcttcatcaccgagttcaagcatatcaccgagcacgagcattttcttccgatagcctttcatcgtttcgattaattcgaccgccgctttcattgacgtcgggctcgcattatacgcgtcgtttacgatcgagatgccgttttccgttttaaccagttccaatctcatccccgtcaccttcaggcggctcagtcccagagcggcattttccggcgtaatgccgaaatagatgccggcggcgtatgcggccatggcattcatcacattatgtctgccgagaaccggaataaagaaagaacgttcgatcccgtcgatactgaagtacgtgccttcttccgcctgttttatttctttcagacggagatcattgtcagcgcctgcgccgtatgtcgttgtccggcaagtgtacgccttttcgcggagcagcggctcatccccgaaataaaacagaacgccgtcttcccgaagtccgtttataatttcaagtttcgcctccgcaattccttctcttgagcctaaatcctgcatgtgggattcgccgatattggtaatgacggcagcttccggttcagcaagacggctcagaaaatcaatttcgcctctcgcgctcattcccatttctaaaacggcgatttctgtatcttcaggcatggcaagcacggtcagcggcaggccgatatggttgttgaaattgccggcggttttgtgaacacggtactgagtactgagaacggcgtgaagcatgtctttcgttgtcgtttttccgttgctcccggtcaccccgatgacccgtgtgccgagttctttcaaataagctttcgccaatgtctgcagcgcctccagcgtgtcatcgacaaggatgacggcacgctcttccggcggattcggttcagagcggtcccacaacaccgcggaaacgcctttttcgaatgcttgcggcacaaaggtatggccgttaaaatgctcgccttttaaaggaatgaacagctgatttttttccaaagtccgcgtatcggttgcggcgccctcaatcattgtttgttcaaatacagggtttgtcagtgtgcctttgaccatgtcggcgattcgttttacagttcgctttatcaaaggtggcacctcgctttctgaaaatgttgtctgttacgggaaaagacactgccccttcaggcagtgtccgtcttcattaaaatgtatgtttaatcagctgtttttcggcatggcgttcttttgccagctcaaccagctgttcgatcagatcactgtaatctacgcctgcttctttccaaagcagcgggaacatgctgaatggcgtaaagcccggcattgtgttcacttcgttaatgagcacttgaccgtcattggtcaggaagaaatcggcgcggacaaggcctgatccgtcaatcgctttgaaggctttaatcgccatctcgctgatttccgcatattgttcatccgtcacttgcgcgggaatcattaaatccgtgtcgccgtcttcatatttcgctttgtaatcgtaaaagtcggttttcggcgcgatttcaccgacggcggaacatttcggttcgtcatttccgagtacgccgatttcgatttctctgccggcgattccttcttccaccacaattttccggtcatactcaaaagccagttcgaaggctttttcaagctcttcgcggtttcggcatttgctgattccgacgcttgacccgaggttcgccggtttgacgaagcacggatatcccagctcctcttcaacctgctgtaagcagctgtccggcgtctgtttccagtccttttttaaaaaagcggcgtacttcgcctgcggaagccccgcttgagcaaacaaatgcttcatgatgactttatccatgccggctgatgatgcaagcacgccgttgccgacataaggaacgttcagcaattccagcagaccctgaatcgtgccgtcttcaccgttcggtccgtggagaagcggaaatacgacatcgatcggcgccttttcgtcaggcgacgcttctggaaacatttcccggttcaatgctgatagagcgaaactttcaccgttttgttccagctgaagcattttcacgttggaaaccggctcagtcagcagcgggcctctttgccattctcctttttcagtgatgtaaatcggatgtatatcaaacttctcagtattaagcgcttttgttacagctaatgctgtctgcagcgatacattgtgttcggctgactttccgccgtacaccaatcctagacttgttttcaatggatattccccccacaacaattcatctttactatcttatcactttcctcagaaaatgatctaattatttttgggcattctgaatatgaaagcatttgtatgtaattcctttttattttatattaaaatggcatggaaaaggagatgtgtcatatgaaaaaaatcagtacaacagaacaatttaatgaacttattcaatccgacaaggaaatcatcgtgaaatttttcgctgattggtgccctgactgcacgcgcatgaatatgttcatcggcgatattttggaagaatataatcaaaatgattggtatgagctgaacagagacgagctccctgagcttgccgacaaatatcaggtaatgggcataccgagccttctgatctttaaaaacggcgaaaagaaagcgcatcttcacagcgcaaacgcgaaaacgcccgaagaagtcacagagtttttatcacagcatatttaattcgtttcacgatctttgtttatgacttcaggctctacatggacatggacatgagtcacatcatgttcatgttttattgcatattcgacttcatcggctacttcatggccttctttcacagacagtcccggatctaccgtaatgaccatttccacatgaaccgtgctccccaaataccttgctttcacatccttcagcctgctgacctcttttatttctttcactgtgtgtttatacggctccaaatctttcagatcaaacccgtccgttaatgagtgggaagcatctttgaagatatcccatgccgtcttacagatgataattccgatcagaaaagcaatgaccggatcaatccacggcagatgaagccgggccgttaagacgcctatcaacgccccaatactgacataggcgtcagaacggctgtctttcgccgccgcatgaagcgcagaacttttaacccgatccgcaagacggctgttatatacatacatgccgtacatgacaatcgcgcttcctagcgccgtccatgccgcaatgaagctcggctcggcctccgttccgctgacaatcgcctttgctcctccgatcagcacttcaataccgaccgccatcataataaaagacgcaattaatgaagaaattgtttcagcccgataatgtccgtaggcatgatcactgtccgcggggcgctgggaaatccggagcccgatcagcacagccagtgatgcgacaatatccgtggcattatttaacccgtccgcactgagcgcttcggaatgataaataagaccgatcaccagtttgacggcggcaaggatgaggtacgcggcgatattaagaatcgcgcctttttcgccccgttttaagtttgccgtttgatcattcatgtaaggactcctccattctcattcatagtatggatggaaaagcggaaaaatagcagctttgatctgaccaaatgcaatattcgacagcattattccccgggaaactatttgtcgaaaaattggcggtatttttcctttacatatgaatatgtccattgtatactttcattaactgataatgattctcaatatcatttgattaggagggtaatcatgaggtcttctcctcagctcagatcatcagttgaaggacgaaaaaaacatctgatccatttgctgatcaataacggaatatacaaaaagtcggaacggcatttatatgaattatcgctcggagaattagaaagcgaatacaaatatgtaaggaaggtgcgggctcatggcgaaacgtaaaataaaaacatacgaacagctgataaaagaaaacaaggcggccattatgaataatcaaaagctgatgaatgtgatctatgacagaattgaccgcaagcatcaaaaactgctcaggcacaacagccatacataaaaagagcctttttcaggctcttttttttattgctcaaaggcttccgccgctaatttgccgatgaccgcatcgtccatcggcggattgtgaaggccggcccgggcatcccgataataccgctgaagcggattatttcgctccaggctttttgcgccggtgattctcattgctttgtcaacaacagaaaggacggcatttgtcacaatatgtttagccgcgccgagctcgcttttgatgaaagggcggcgtttcgggtcatcatacatttgcgccgccgtgaagagaaactgtctcgcttttaacaattcaagctccatttccccgacacgctgctgaacggccggcacgtctttaatcggtccgttcaggctgttcggcgaatattcagatgcaaaccggacggcatagtcccttgccgcttgagcgatgcccagataagcagcgggaatgtgaagcagccagccattcactttcgccgctctcggcccgctgataagctccacaagccgctcgtcactgaccgtgacatgatctaaaaggagatcatggcttccggtcgccttcatggcaatcatatcccatgtttcttcgactgaaacgcctgcctgatctttatgaatgagaaaaacaccggtcgtttgtttttcttcaatccatgccgtcacaagcatataatccaaagtcagcgaaagggttgtaaaggtttttcggccgttcagcacccattttccgtcttttttgacagcggaagtgccgggtcttcctcccctcgtcggactgccggtctgccgttccgtcgctgccctgttcaggacggctccctttttcacctcttttgtgataaatgaaaagacaccttcatcccagctgtttccttctccgagctcacccatgacggataaatgccagccgattccgagagcgacggccgcgtctccccgcgccagccgttcctgaaacagcaccatctcataaacggaaatgcctgcaccgccgaatgcctcaggtaccgttaacgccgtatatcccgcgtcgcgcagtctttgaattttctccgcgggaaaacggcccgcctcatcatcaagcgcggctgttttttgaaattcgtctgcaagcaggccgattttttccatccattcccgctgccgttcattctgtatccataaagacactggaatccccccattataattccgataaagttaataagtattatagagattcaagtctcgtttcgcaactgtaaggctgtacaaaaaaacacgctattccatagaatagcgcgttcagactgcttccgggccgcggtcctgcttgagcccgagataaatcagcatatatgtgagataacccatcgtcatcacaagcccgccaaagaaaaagcttgaaaaaatcggctcttcaaacgcggtaaccgccgcaagcacgatccagcttgcatacaggtagatgatgaaataacggaatcccgtcttcattttatataagagaaacagccccactgtagaaaacaaacccagcgcaagcctgaaataaacaagatgttcgaattgaaacatgaatgacacaaaggaaaaaccaagcaataacacaatcggtaatgcggtaataaaatttctcaagtgagcacctccgtcattacctttattataaatcaaaatagcataaattattgatttatcgtgatctttttcacaaaaatgtcattcctttactttatacccgaacatcgcgtttgcaaaagctccaccaagcgacggctaagaagaatacgatatggataatgataatgcctgcggaaaataacggcgtcattcccgcaaacagcggcttcgccccgctcatatattgcgtcaggtcagtatttgcgaacagcagaaaacttccccatttgttttggaagagcgacataatcgtcacaagtgattttgcgccgtacagcacgataaatgacaaaatgacggccgttgcgctgtttcggaatacagaagaacacaacaagccaaagcatgccatcgcaaacgcctcgacccagttcgtgccgattactttcagggtgttcacaagaagcgtccctgattcagatgtcaccgacactccgaagaaagccatgccgaacagcagagacagaatatagtacgccgcatacaggtacaagctgaccaaaaatacggtaatgagtttagatacaaaaatccgctcccgctttaccgggcggattaacaaaaatttgatcgttttcttatcaaattcagcggaaatgatcgttgccgcgatcacgatcgttaatgcctcaagcagaatattcagcccgggggcgtacgccatatagccgatgaaattctcatccgttccggaactgatgacaagccgtttaatgacaagcgccataataaattggagaacggccatcagaatcagcgccactaatgagacttttcggttaaagagtttcatatgctcattcgctgtcaatttaaacattcgtctccccctcctcttgaagcgccgtcgtcactttcatgaattcatcctccagcgattccgcatacggcatgatggaatacacgagaaagtcttgtccgacgagcgcacggtttaatgccgggatgtccttcttcgctacggtgacggtaatgctcccgccgtttttctccggaacgaattgctgctgggacagccattcgaaggcttcgtcagccggctgaatgtcgaggatggctttttcttctttttccgcagcgccgcgcagaacaacctctgttttgatctcacctttttgaatgatgatgacacggtcgcaaaggtcctccacttcacgcaataaatgcgtcgcaaaaaggatgctcgtcccttcaagctccgcgagttcctttaagtgatcgcggaaatccttcattccgccgggatcaagcccgtttgtcggttcatctaaaatgagcagattcggacggtgaagaatggcctgtgcaatcccgagacgctgacgcatgccaagggaatacgttttaactttgtcatgaacggcatttgtgagcccgacccgctcgatgacttcctgaagcctgtcttctttgatgtttttgtgcatgttggcaaagtgcttcagattttcccaccccgtcaggtacgggtagaattcaggattttccacgatcgctccgacggattcaagcgctttttcgaaatcagcatcgtgctgaaagccgttaattgtaatcgtgccgctgtttttctttaaaaggccgacgatgattcggataagtgtggtttttcccgacccgttcggaccgagcaaaccgatgatctcgccctgcctgacatccatgctgatgttttttaaaatgtgctttttgcctattgttttgtcaaggccttcaatatgtaaaatcggctcagtcatacagccttcctcctttttcacaaaaaataaacagtgcccgtacataggcactgtctgcattataacattagtcatatattcgtgaagagccggagccgtcgttatgtcttatccgggaccggtccgtttttttccttctcctcattattgacgacatccagaatatcaagcaggaacacaaaaatcggaattccgataatcaagccccaaatgccgaagaaatgttctgagaaaatcagaaccgtaaaggtaaaaaagatcggcagttccgtttttgctgacatcagtttcggattaaggaagtacgtctcaatcgcatgaatgacgaaaatgaccagcacgatgtagatgacgtacgcagcgccgcccgtcgtatacgcgatgatgctgagcggaatgagcgaaatcaccacacccgccacgggaatgagcccgaggaaaaagaccatgatggacaggccgaacagctgcggaaaatgcagaatcgccaatgcgatcaaggtgaggatacagttcaccagcgcgataataaattgggcttcaagcactttgccgaatgttctcgcaaatttgctgccgaaataagcaagttcgtagtaaaaaacagacagcttgctgtgctgaaattttttcataaactccgtgagccgctttttctcgaacaggaaaaacatgctgagaatcagtgacatcacgacctgcaaaccgaaagtgctgatatcggccaagtatgtatacagtacattaaaaccttcttttacataggaaccgatattgatatcgccgaacacgctcgatatctcatcataaaacggaatgacatcgggatgatacgcgatgtgcttgatctgcttaatcagctgttcaatctgcttggcaacaatcgggtaaaagacaaagcctccgacagtcgccccgacagccagcgcaatatataaaatggtgatgaccaccctctggctgatccggaaaaaatggttcaacacatgccggatgacagtctccagccgatccatcagaaaagtaaaaataaacgtaagcaaaatcaaattaatcatacttcggaatacaactaacaccccagtcaaaacaagaaaaacggaaaaacgtctgacacccggatgctgaaaaaatttaaaaatagccgccatttatacactcctgctaggacaaaaagcccttagatttcatctttcactctctaattgtaaattatataacaaaatgacgctaaggtctttgtccacctcctaataaatttaaacaaatttatcttttttactcatggcggccgaaaaaaagaacggcatgccggatgcatgccgttcctttccttttataccgccgttttcatttcttttacggcctgtgtgcttttcgcttcgtcaaactcattttcgctcttggctacgatgatggtggcgattccgtttccgatcaggttgacgatcgcccttccttcactcataaagcggtcaacgccgaggagcagcgccagtccctccagcggaataacctgaagcgccgataaagtggaggcgagcacgataaatccgcttccggttacgcccgccgcgccttttgatgtcagcatcagcacgagaatgatcgtaacctgctggccgatggtaagatcaacgccgaacacctgcgccagaaaaaccgtcgccatggacagatagatcgaggtgccgtccaggttaaaagaatatcccgtcggaatgacaaggccgacaaccgatttggaacagccgtaacgctccattttatccatcatccgcggaaggacggactcagaagagcttgtgccgagaacgatgagcagttcatctttaataaaacggagatagttccacaagctgaaaccgaatagtttgcaaatgatattcaaagcgacaaatacaaacaggaacatcgtaacgtatacagacagcatcagactcgccagcggcttgatggaatcaaggccgaagtgcccgatcgtataggccatggccccgaatgcgccgatcggcgccgcgcgcatgatgtagccgatgattttgaaaaaaacgtgcgacagtttatcaaagaaatcaataatgcttttgcctctttcaccgagcgccgccaggccgacaccgaataaaacagaaaagaataagacctgaagaatgtcgccttttgcgaaagcgtcaaccatatttgacggaacgatgtgagtgataaattcaatccagtcaatcccctgtcccccgttttgggtgtactgagagacatcccctttttcaagcttgctgtaatcaaggccctcaccgggtttcatgatattgacgaccagaagtccgataataagggcaatggtggtcacgacttcaaaataaataaatgcttttcccccgactttgccgacttttttcatgtctcccatcttggcgatgccaagcacgatcgtcaggaatatgatcggtgcgataatcatttttaccgcattgataaatgtatcgccgagcggcttcatctgcttcccggcctcaggccaaacgagtccgacaatgacgccgatgatcaccgccgtgatgacctgcaccgtaagatttttgaaaattttcattcctactcccccttgcctctcgctgcgtctatacaaaaatgatagcgttttcatacgaagaggggaagcttatgatcataacggacattttggtctttttggtctcggctagcggacgaatttgtagcggttaaccggccgtcccactcccccgtattgaatgtcgagcttaatctgaccgtccttctcaagaaaatcaagataacgccgcgccgtcacccttgcgattccgagcgctttggcggcttcttcagctgaaagcggctccgtctgctgtttcatataggtcaaaatttcattcatcgtaaaatggtttaaccccttcggcagatcccgggacggattttgcggaattttcagcagcatgtcaagctgctcttgcgacatggtgtcatgctcttcaattttccgtttatattgtttatagttttcgagcgcctgcctcatccgctccagcttaaacggcttcaaaatatagtcggccgcaccgttttgcagcataagctggattgtttctttgtcttttgcggccgagacgatgatgacgtccacttcgagcttttgttttctgatttcctggagcgttttaattccgtcttttttcggcatgtatacgtctaataccacgagcccgggccgcagatcttttataagcctgattccctcgtctccatcagcggccgtggcgatgacgctgaaccctgaaacaccggtgataaattctttattcacctcctgcaccatcgggtcatcttcaataagcagcaccttgatgtccatcgaatgatttctcccccttcatcggaaataatatagaaaatgccgttccctgtccctgccgtgtgtcgacttcaataacgcccatccctttgtcgacgatttgtttgacgaggtacaagccgtatcccgttcctcccgttttattgacggtaaaccctttgtcataaaggcgcgggatgtgctgatcggaaatcccgcttccgttgtcttctattaatatagcaagcacttcatcattttgctcgatactgatgtcaatatgtttgtcctccgtgtccgctgtttcgaatgcgccgaacgcattttcaattaaattgccgagcaggacgacgatgtcatgctggtcgacatgctccggaaatgccgagaaactgctgttttcatcaattttcacagaaatgccaagctcttttcctcttttgattttgcttaacagcagccccgccgcggcgtcattctgaatggcctgatgaagaaaatcagtgacgctttcttgttctgatgattccttaaaagcaagccggagcgctttttctgattttccgagctgaatcagccccgcgatggtgtgaagcttgttcatatgttcatgattttggactctgagcgcatcgacaaaatttttcacacctgtcagttcttccgccattttcgccgcttccgtcctgtcctgaaaaatggcgacggctccgatgaccttctttttcatgacaatcggaattctgctgctcatgatcacctttccgctgacttggatttcttcattatatacagctcggttccgctcgacgatttcagggagccgcgaatcttttaacacgtcccagatcagcctgccgtcggtctcttgtctgacattgaatatctgcttcgctttttcattaaaaatggtgatgtgatgctgattatcgatcgcaatgacgccctcattcatcgaatgaaacgtagcggtccgttcctcatacattctcacgatctcatggggctcgagccaaaacatttgttttttgatgtggcgggccagcaaaaaggagccggccagtccgaacccgagcgccagcagaacgataaacagtatttcatgtttcagctgaagaagaatttcaccgaatccgggcagcgttttaccggcaaggacgacgccgatctgattcaaatcccggtctttgatgggataaaaagcgcggacggcggtgccgatctctccctttgcttcggaaaaataaatgtgctcggcgaacgccgcggcttcgtcctcaccccttgaacgctttccgatcattgtgctgacgggatgtgaatagcggatatgatccatatccatgacgacgatgtagtccgcttcattgatgatccttatttcttcgaccgcatggcgcacgtcttccctttgttttttctgctccagggcgcgtttgacatcggtcatctcagataccgtccgcgcggtattcatcagccgttttttcagctcacgctcctctgtatgctggatattgccgaccagcacgatgccgacgatcaaaaaggtaaaaagcacgacgatataagaaagtatggtgattttccagcagatggtaagcttttttttcgtcattggcctcttcctttccgtctctttacgaaaacggcccgcccgattatgcttgttatagaaaatggcggagggggttttcgatgaaaagcttgctgacttgtctcagcctgatggtgctcggtatcggaaccgctttattcatcggctttcatgatcgtttctcaacagaagaaccgtattatgatgacgaacaggaaggcctgaaagatcaaatggttttcaaattcagccatgtcgtggctgaaaacacgcctaaagggcgggcggcgaataaatttgccgacctggtctatcaaaagtccggcggcaccattaaagtagaggtatttccaaacgggagcctctattcagataatgaagaaataaacgccctccaaaacggggacgtgcaattcatcgctccctccacctcaaagctcggatcactgtctcccgaatggggtgttttggatctgccgtacgcgtttacaaactataaagccgtgcaagaaggcctcaacggcaaaatcggcacgcgcctgttcgcttctttagaaaagcatcatttgaaaggactggcgtactggacgaacgggtttaagcagctcacgtcaaataaagggccgatcttcactccggacgatttgaaagggcaggcgctcaggatcatgccgagcagcgtgatcgaagaccagtaccgcctgctcggcgcgcacccgcggcaggattcctttaattccacgtttcagctcttggaaagcaatctcgtagacggagaggaaaatacgatttcaaatatctattctaaaaaattttataatgttcaagattatttgacaatcagcaatcacgggtacctcggttatgccgtgatgaccgacgagcatttctggaattcacagacagaaaaaacgagaaccatcttaacggaggcgatgagagaaacgacggaatggaacgaagcctccgctgagaaaatgaataaagaccagcttgaagagataaagaagaattcatccattcatattcatgtgctgagcaaagcggaaaagaacacatggatgaaacgcctcgacccgatttacggacaatatgaacaggtgatcggccgcgggcttgtgcaggatttgttatccttgcgccgcgagccttagcaggaccaatacgcccatctccgtttcatcccttttcccgccggggaagtaaatagggacagagcaaaaaaggagatggagacatgtttacacatacgaaaaaactgcagcatccggctaaaccggatcgtcctgacccgctgttcgcaaaaaagatgcaggaaattttagggggacaatacggggaaatatccgtcgccatgcaatatttgttccaaggatggaatacacggggcaatgaaaaatataaggatctcttctgatggataccgcgacggaagaaatcggccatgtcgaaatgatcgcgacgatgattgcgagactgttagaagacgccccgctggcagagcaggaaaaagcggctgatgatccggtcatcgggtccattttaggcgggatgaacccgcatcatgccattgtctcaggactcggcgccatgccggagagcagcacgggcgttccgtggagcgcaggctatatcgtcgcaagcggaaaccttctggcagacttccgcgccaatctgaacgccgaatcacaaggaaggcttcaagtcgcacgcctgtatgaaatgaccgatgataaaggcgtgaaagatatgctcagctttttattggcccgcgataccatgcatcaaaaccaatggcttgcggccattaaagaattagaagaacaggaaggtccgatcgttccttcgacattcccgaaggcgctggaaaaacagtcattctcccataagcttattcatttctcagatggagcagaaagcgctgaacaaaattggctgaaggaaacagcgccggacggagaaccatttgaatacgaaaaggaaccgaaagcgcacggcgaaatagctaagctggaccccgtcccgccgtatgtccacaacacgcttcccggacgaaaataaaaaagcctctaaaggggctttttttatgtgcgcacaactgtccaatccggttcgtatcggatgtccaggtgatgtaacagctcgtgaatgacaggttcatccccctcgtacagcatcacttccattgatagaatcgcagccttctgctcgttttcttcgtatatgcggtcatgttcgttctccataaaatcatcataggcctgtctgtcctcccaaacgctgatgatctctgcgatgaacaggccgtctgcgtttttccgccagccgccggcctgtctgacgaagccatttacacatgataatgctccccaccttgactgtgcttgcgcaaatgcttcagcgtttgcagcgtctgtttcacataaaatctttttgatcagcatgaccgttcctctgtgatgactgttttcgcatgcgtatgctcgacacagagattcacggttctgacgtaagagcgggtgcggtgaatcgtgcctttcgggatgagcaggctgtcatttactttgagcactgcggtttctttgtccttaaaatcgatcagcagctcaccttccagaacgatgaaccattcatctgagtcagggtgatggtgccagtcatattctcccgtaaacactgcgaggcgcacacagtggtcattgatctccgcgattgaaaaattgtcgtgtttttctttgactttattggcgatagcgagcaaattcagcatgtcagacacgagtgaaaaacccctttttcattttattgtatcggttttgcggctcagatcaagattttcccaaaatcaaaagcgatccggctgatgtgccggatcgcttttgatctgcaggttgtctgccttttatgcttttattagctgcttcgtctgtttccgcctttttggccgatttcctgatagaattctttgtcgtgatttttgcttgtggcttctccgcct

SEQ ID NO: 136 - DNA, 26690 bp, Bacillus velezensis FL50S
tcgaatctctcctgggacgtacaaaaaaagagctggtgacatcagagtgaaaactgatgccgctggccttttttatcggatgactatattgtcaattcactgatatcatggtaaaataatcagcagatatttgtttttcatgtcccagtagctcagccggatagagcaacggccttctaagccgtcggtcgggagttcgaatctctcctgggacgtataaaaaacctcaagccctgacaatgggtttgaggtttttttgtattttatttttagttttacgaaacaaaagttccgtatttgatgaaaattgtaaagtaattttaatgtaaatgaaacttaatgtaatatttaccgtaataaatatatgtataaagatacttaaggcgcccttgagtgataaattatctgatttctatcatacgttttgttgatgattgatagaaagacagcaggaggaattagcttttgaagtacgcatttgcatataaaaatcacaatatagaaacgatcttttgcggaaaagacgagctgtttgaggaactgaaacaatttttaatcactcaatgcggtttaatcattgttgaggtttcaagggctgattactatacggagcaggaaatgaatcagtggaatgaacgttatactctgtgaataagaaaagaaaccggccgtgtgagaccggtttttgtatcatctgaatccgctcggagcgctgaagcccccggcatggccgctgaaaccgccaccgagcgcgccgggatgtgccccggcgccgaggcttccgccgacgtcactgaaggtttggccgtagtacccggatgtataagggtacggaacgaattgctgtccggcgaatgacagtgtgctttgcggggtctgctgtccgtatccggatggcggaaatccctgctgaaaagaagggccgccttgatatggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtataaagagcctgttcaatcgaacggaatatctgacaagcatgccggaaggacagagaaaaatcgcgtaataaaatgtgacatattcgtatatgaacggaaaaatttcatgtaatcttgagagattaataaaaaaaatataaaaacttttaacatttgccgatccttttatatcagtaatgaaagcgtatacaaaatagattgattaatctaaattgtctaataattataaaaatgctgttgacactgtctgcaaacgggcgtaatatgagttcaaacaaaaataaataaatgattcacgctaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatgtaaagagtaggactcggccgagtgaacgcaatgtttactcgttatcaaaacggataatcattatccatgagacggtctgcatatgaccgtaaacaagggtggtaccgcggagagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacccggagcgacaaatttagttaccggtcttgcggatgcgatgattgattcactgccgctcgtagtgtttaccggtcaggtcgccacttcggtcatcggcagcgacgctttccaggaagccgacattttaggaattacgatgccgattacgaaacacagctaccaagtccgccgtccggaagatctcccccgtgtgattaaagaggcgttccatattgccacgacgggaagaccgggcccggtattaattgatataccgaaggatgtcgcagcatttgaaggagaattcagatatgatcacgagatcaatcttccgggttatcagccggtaaaagagcctaactatctgcagatccgaaagctcgtggaagctgtcagcagtgcgaaaaagccgattattttagccggagcgggtgttttgcacggtaaagcttcagaagatttaaaaaattatgctgaacagcagcaaattccggtagcgcacacgcttctcggtctgggcggtttcccggcagaccatcctctttttctgggaatggcggggatgcacggcacatacacagcgaatatggcgctttaccactgtgacttgttgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttcaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaaccttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgtccggatttcatcggaagaagaggcggaagaagagcttaaaaaggcgctttcatcaaaagaaccggccgttattgacgtccgggtcgccaaaagcgagaaagtattcccgatgatcgcgccgggtaaaggacttcatgaaatggtgggggtgaaaccttgaaacgcattatcacattaacggtggtcaaccgctcgggggtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcatcgtcgttcaggttaccggcgaatctaataaaatcgaagcgctcatagagcttctcaaaccttacggaattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcatgcacacgcgctgaacttaaaagaaagcggaattgatgtcattgtcggcgtcagacaaggcaagtcatttacacaggcccaagaagacggtcataaagtcttttcggtaagagaagcggctgcccaggctgatatcattatggttcttcttccggatgagcagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggacctggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggggttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagctgatcgtagacttgatgtatgaagaaggattggcgggcatgagatactctatctccgatacggctcaatggggagactttgtatcaggaccgcgcgtagtcgatgcgaaggtaaaagaatcgatgaaacaagtattaacggatattcaaaacggtacattcgcaaaagaatggatcgtggaaaaccaagtgaaccgtcctcgtttcaatgcgatcaatgcaagcgaaaacgagcatcagattgaaaaggtcggcagacagcttcgtgaaatgatgccgtttgtcaaacaaggcaaaaagaaggaagcggtggtctccgttgcgcaaaattaatgttttcgacacgacccttcgtgacggtgaacaatctcccggggtcaacctcaattcccgggagaaactggcgatagccaagcagcttgaaagactcggggtggacattattgaagcgggatttcccgcttcatcccgaggtgattttttagccgtgcaggaaattgcaagaacgattaaaaattgttcggtaacagggcttgcccgatctgtcaaaggtgacattgacgcagcctgggaagcgctgaaagacggggtcagcccgcgcattcacatctttatcgccacctctgacattcatctgaagcataagctgaaaatgacgcgggaagaggttaaggaaaaagcggttgaaatggtgaagtatgcaaaagaacgctttccgatcgttcaatggtcggcagaagacgcatgccgcaccgaacttccgtttctggctgaaatcgtagaagaagtgattgatgccggcgcgagcgtcatcaacctgccggacactgtaggttacctgacgcctgctgaatacggaaacatctttaaatatatgaaggaacacgttccgaatatcagccgggtaaagctctccgcccattgccatgatgatctcggaatggcggttgccaactcactttcggcaattgagaacggcgctgatcaaattgaatgcgccattaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggcatggccgttccccgcaacaaagcaatcgtcggagataacgctttcgcacatgaatccggcattcaccaagacggtttcctgaaagaaaaatcaacatatgaaatcatttcaccggaacttgtcggcgtgactgctgatgcgctcgtactcggaaagcattccggacgccatgcgttcaaagaccgcctgaatgcgcttggattccagtttgatagtgaggaaatcaataaattttttacgatgtttaaagaactgaccgaaaagaaaaaagaaatcaccgatgatgacttggtttctcttattttagaagaaaaagtgacggacaaaaaaatcggctatgaatttctgtctctgcaagtgcattacggaacgtctcaggtgccgactgcaacagtctctttgaaaaatcaggaaaacgaacagctgattcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttatgtcagagtgaccgtgaacggaaaagaaacatcaggacggggaatcgcgcaggatgttctggaagcttctgcaaaagcttatctgaacgccgtgaaccggcagttggtgctggattgcaatatagacggattaaagagacggactgcggtcggctcgtaatagaaaggagaacgtttgatttgaaaaaacgcattgctttgcttccaggtgacggaatcggaccggaagtggcggaatcagcggcagatgtattgaaaagagttgccgaacaattcggacatgaatttgaatttgaaaacgggctgatcgggggagcggcgattgacgcccatcaaaacccccttcctgaggagacggtggctctttgtgaaagatccgacgccatcctgctcggggcagtcggcggaccgaaatgggaccaaaatcctccggagctcagaccggaaaaaggcctgctcggcatcagaaaaaagctcggcttgtttgccaatctgcgtcccgtgaccgtatttgaaagcttgtctgaggcgtctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgctggcagaaaaggaaaagtgacgtccgttgataaggcgaatgtgctttcttcaagcagactgtggcgtgaaacggcggatgaaatcgcaaaagaatttcctgatgtgacgcttgaacatatgcttgtcgataatgccgcgatgcagctcatctacgctccgagccagtttgacgtcatcgtaactgagaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagcggcgatgcttttgagaacatctttcggacttgaaaacgaagcgcaggcggtggaaaaagcggtcgcaaaggtgcttgcagacggcagccgtacacgtgatatcgcccgggacggccaatatgccggaacgcatgacattactgaaaaagtaaaagccgcattagccggctcgaatacaaaatctatagtgtgacgctttaaagaaagcggtcttagttcataggtagagggaggaaacaaagatgatgcctcgaacaatcatcgaaaagatttgggatcggcatgttgtaaaaagcggtgaaggaaaacccgaccttctctatattgatctgcacctcattcatgaggtgacgtctcctcaggcgtttgaagggttaaggcagaagggaagaaaggtcagacggccgcagaacacgttcgcgacgatggaccacaatattccgaccgtcaaccgttttgacattaaagatgaagtcgcaaagcgccaagtaaccgcgcttgaacggaattgcgaggagttcggcgtccgtcttgcggatcttcacagcgcagaccagggaatcgttcatgtggtcgggcctgagcttggtctgacacttccgggaaaaacgatcgtttgcggagacagccatacatcgactcacggcgcgttcggagcgcttgccttcggtatcggcacaagtgaggtggaacatgttctttccacacagacattatggcagcagcggccgaaaacgcttgaaatccgcgttgacggaacgctccaaaaaggagtgacagcgaaggatgtcatcttgtcggtcatcggaaaatacggggtgaaattcggtaccggatatgtcattgaatacaccggggaagtattcagaaacatgtctatggacgaacgcatgactgtctgcaatatgtcaatagaagcgggagcccgtgcgggactgatcgctcctgatgacacgacgattgaatactgtaaaaaccgtaaatacgcgccaaaaagcgaggaatttgaaaaagccgccgcagaatggaaagcgttaaaaaccgatccgggcgccgtatacgatcattccatcgtgttagacggcagcgagatttctccaatggtaacatggggtgtcaatcccggcatggttcttccggtcgatgcccaaatacctgcgccggaaacgattgattctgaagacggtaaaaaagaagccatccgcgcttacgaatacatggggatcgcgccgaatcaaaaaattgaagatattaaagtcgagcatgtgtttatcggctcctgtacaaattcacggatgaccgatcttcgccaggctgcggatatgatcaaaggccgaaaagtcgccgacagcgtcagagccattgtggtgccgggttctcaaagcgtgaaacagcaggccgaggaagaagggctgcaccgcgtgtttctcgaggccggctttgaatggagggaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcggccattcacgggcatttcgtcgatgtaagaaagttttatcaagaaaaaacagttgtgtaaggagtgcgcgaaaagatggaacctttaaaaacgcatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaaccgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcagaactgttttaaaaacggtatgcttcccatccgtatgccgtatgatcagtggaaaaaactcgccggtcaatatgaaaatcagtctctaaatatgacggttgatttggaaaaccagctcattcacgacagtgaaggaaaagagatttcatttgaagtcgatccgcactggaaggaaatgctgattaacggttatgatgaaatttcattaacgcttctgctggaggacgacattcagcagtttgaatcgaaaagaagttcatggcttcaagcctgaaaaaagccgcccggcatctgtccggcggctttttttaccgtgtgcatcatcctttcttgtgtttcatgacgcgtgttgatacacttgaacaaaataagcgcctgaaaggaaataaagtatgacgcatgacaagaaaaaagctgatatcattcctttcccccgtctgaaagaacgcttggttgataaagggatggccgccatgaaggataaacagtatgaggaggccctcgaactgttttcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtattgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggaggaggcgtgggaggaggaatacgaggacattcttgatacggaaaaagtgctgaacagccccgctgaacaaatgaatctgattcattctcttaaagaccgcaatattgcaaaatacacgggtctcttaaaaacgattcttcaagatccgggcgcgcatcctcttattaagacaatgattttgacgctgatggccgagcacgactacagtaaaccggtccatattacaaaattcggcgattcaatgaccgcgataccgagtggaacggtccagcctgatgcggctccgattttgcatcgcgttctccgggtgcttgatgaaacgctgggcaatgaaaaccctacattatatgctgccgtcgaggagctgtggagaagacatctgtacgtcctgcacccttttatgccgaagtttttgaacgcggatttatgggcggcggcgcttcataaggtcggttacgagatgcacggcattgacattgagccggaggaacttcatatgatgtacgagtttgacagccgcgaactcgaagaagcctgcacgatgattaaggatattgaagaaatttcttatttgtaaatcacaccatatagttgaaagcggtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgcggatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttaattttcactgcaaaagtgactgtaaaaccggaagtgaaacttggcgattacaaaggcttaggaatcgaaaaagatgacactgccgttactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactactcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaaccgagaaaacaaaaaaacgccttgaagaagcaaaagaaaacgaagctgacgctaaattgcgtgaagagcttgttctgaaagcatctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcagaaaaccttgaagtaacggacgaagaagttgaagcagagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacggaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaattccaacagtaaagtggatgatgttgagctttctaaaagtaatatttctttaatcggaccgactggaagcgggaaaacacttcttgcccagacgcttgcgcgtattctgaacgttccgtttgcgatcgcggacgctacatctctgactgaagccggatatgtcggtgaggacgtagaaaacatcctcctcaagctgattcaggcagcagactatgatgtggaaaaagcagaaaaaggcattatctatatcgatgaaatcgataaagtagcgcgaaaatctgaaaacccgtccattacacgcgatgtatcaggcgaaggcgttcagcaggcgctgctgaaaattcttgaaggaacggttgcaagcgtgccgcctcaaggaggacgcaaacatcctcatcaggaattcatccagatcgatacgacgaacattctgttcatttgcggcggtgcatttgatggcatcgaacaaatcatcaaacgccgtctcggacaaaaagtcatcggcttcggctctgataataaagcggcagacctggaaaaagaagaactgctttctaaagttcttccggaagacctgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaaggcgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcgccgcgtcttgtattaaaagacggcactgttgtcggccaagataaaacatcagcataacacgacaaaacctcctgacccgaattaatcaggaggtttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggactatatttttggaatctgctcaaaaaccagcgaacacaaaaagtgacgatagataaagaatcaaaaaaggaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggctggtattggaagaagcgaaaaagcataaacagtcaccgtttcaaaagcaggctgtttttgttgaacttgatgcgacgaccgcgcgatttgatgaacgggggattgccgatccgcttatcggttcagtgcatgatccgatttatcagggagcgggtgcgatgggccaagcaggcattccgcagccgaaacagggggctgtgacccatgctcacggcggggtattgtttattgatgaaatcggcgagcttcacccgattcagatgaataaaatgctgaaggtgcttgaagaccgaaaagtatttttagacagtgcgtattacagtgaagaaaatacgcaaataccgaatcacatccatgatatttttcaaaatgggcttccggcggatttccgtttgatcggagcgacaacgagaatgccgactgaaattcctccggccatccgttcgcgctgtcttgaagtatttttccgcgagctggaaaaggatgaacttaaaatcgttgcgaaaaaagcagccgacaaaattcagaaagagatttctgacgaagctctcagcgtgctgaccgcatatacgagaaacggacgtgaagccgtcaatatgatccagatcgctgccggcatggcggtgactgaggacagaaaagaaatcacgacagaagatatagaatgggttgttcattccagtcagcttacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcgaagggatctgtggaaaatgtgctgacggttctccgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccttatgaaaatcagcagtccattctgaaacgaatagacggaatcaccattaaagcggtaaaaacgttccaggaagtgcttgacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattaaagcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggttgattcaaaagacgtggaagacgaagcgcttatgcggacgctgctggaccattttgaccagtacataaaaatttctaaaaaaatttccgcagaaacgtatgcggctgtgactgatattgaagagcccggcagaatggcggatatcgtcgcttctcatctcccgctgaaattaaaggacaagcaggacattttagaaacggcggatattaaagaacgtctgaataaggtcattcgttccattcataatgaaaaagaagtgctggagattgagaaaaaaatcggtcagcgcgtcaaacgttcgatggaacgcactcaaaaggaatattatttgcgcgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatatcgactggctcatcgcccttccgtggtcggatgaaacagaagataaacttgatattaaaaaagccggggaaatcttagataaagagcatcacggcttagagaaagtgaaagagcggattttggagtatttggccgtgaaacagctgacgaaaacgctgaaagggccgattctttgtctcgccggacctccgggagtcggtaaaacatctcttgcaaaatcaatcagtacgagcatgggacgcacttttgtgagaatttcactgggcggagtgcgcgatgagtctgaaatccgcgggcaccggcgcacatacgtcggggcgatgcccggccgtattatacaggggatgaaaaaagccggcaaacaaaatccggtctttctcctcgacgagatcgacaaaatgtcgtctgatttcagaggcgatccgtcttcggcgatgcttgaggtgctggatccggaacaaaacagcacattcagcgaccactatattgaagagacgttcgatttatcgaaagtgctgtttatcgcgactgcgaataaccttgcttccatccctggccctctcagagacagaatggagattatcagcctgtcaggctacactgaaaacgaaaagctggagatcgtgaaagaccacctgcttccgaaacaaatcaaagagcacgggctcacaaagagcaacctgcagattcgggatcaggcgattacggacatcatccgctactatacgagggaagccggcgtgagaacgcttgaacgccagattgccgccatttgccgaaaggctgcaaaagccattgtgtctgaggagagaaaacgcattaccgttacagagaaaaatctggccgactatctcggaaaacggatattcagatacggacaggcggaaaccgaagatcaaatcggggttgtcacggggctcgcgtatacgacggtcggcggagatacgctgtcaatcgaagtgtcattgtcaccgggaaaaggaaagctggttctgaccgggaagcttggagatgtcatgcgggaatcagcgcaggccgctttcagttatgtccgttcgaaagcggaacagttcggaatcgacccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaatcacgctgcgggggcgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggcagatcaaatgtaggaaagtcatcttttatcaattcattaatcaatcggaaaaacttggccagaacgtcatcaaaaccggggaaaacacagactttaaacttttacatcatcaatgatgaattgcattttgtcgacgttcccgggtacggatttgcgaaggtttccaaaagcgagcgggaagcatgggggagaatgattgaaacctatatgacgacccgcgaagagctgaaagcctgcgtgcagattgtcgacctcagacacgcgccgtctgctgaagacgtgaacatgtatgaattcctgaagtattacggcattcccgtcatcgtcattgcgacaaaagcggataagattccaaaaggaaaatgggacaagcacttaaaggttgtcaaacagacgcttgatatggatcctgaagatgagctgattttattttcctctgaaacgaaaaaaggcaaagatgaagcatggggagccattaaaaaaatgatcagccggtaatgaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcagccgcttcgtatacatattcttttctggcagccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcacagcccccaagagcataaggagcaccggccattccccctgattcgcaaacaggtgaacctgtccgctctgaagccatgcaaataatgaagcggcaagcagaagtcccggtaataaaattgatgtttttttcatcctgtcacctacccgcagtaaaggatttttagtatgatgattacagtgggaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgctccgcttaaaagaagaaaaaagcgttctagaaaacattatcgtgtcaacctgcaaccgcaccgaaatatatgcggtggtcgaccagcttcataccggccgttattatataaagacatttttatccgaatggttctcgctgccgaaagaagagctgtctccgtttctgaaattttatgagagcgacgcggcgatcgagcatttattccgtgtggcgtgcggtttggattccatggtcatcggagagacgcaaatactcggccaggtacgctcgagctttaaaacggcgcaggcagaaaagacgatcggcaccattttcaatgagctgtttaaacaggcggtgaccgtcggcaaacgcacgcatgccgaaaccgatatcggctccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggtatcggcaaagtaacggtcatcaacagaacgtttttgaaggcaaaagcgcttgctgaccgtttctccggagaagcgcgcagcttaaaccagcttgaatatgcacttgctgaagctgatattttaatcagttcgacaggcgcgagtgatttcgtcgtgtctaaagaaatgatggagagagcgggcagacagcggaaaggccgtccgttatttatggtggatatcgctgtgccgagagacctcgatccggcgcttaacgatcttgaaggtgtttttctgtacgatattgatgaccttgaaggaatcgttgaagccaacttacaagaacgccgcgaaaccgctgaaaaagtcgagctgtttattgaagcggcaattgttgagtttaagcagtggcttaatacgctcggcgtcgtgccggtcatttcggcgctgcgtgaaaaggcgctgtccatccagtccgatacgatgcagagcattgagcgcaagctgcctcatctgacggtgagagagaaaaaacttctcagcaaacatacgaaaagcatcattaaccaaatgctgcgcgacccgattctgaaagcgaaagagcttgcggctgaagcggattcagatgaaaagctgaagctgtttatgcagattttcgatattgaggaagaggccggccgccagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctggaaaaatagccttctggttgctttctattgtctggactctgcaaactgtctatctttcttatttcatgtggcagacgggcagatttccggtcttgaatattacagaggccctttacttttatgcgtgggtgcttgtcacgctttcacttgtggtcacgcagattctgcgggttgattttatcgtgtttttcacgaatgtcatcggtttctcgatgattgcgatccatacgttttcaccgacggatcagcattcggccgccttttccggccagctggtctcagagcttttggtcattcatattacaatggcgattctgtcttacggcgctttttccctttcttttgtcttttcgcttctttatcagtttcaatattctttattaaagaagaaaaaatggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgactcaaaagtgctcggctcgtttattgtgctgcttttatacagctactatttatatatcagaatgattaaggaactgcaggggaaagtggcggcgttatggaattcagcatgttttctcgtgctgatgattaattacttcctgctcggaagcctgtcacaattccattggttcagttaacgcacgcgcccaaacagattcgggaggaaagaaaatgagaacgattaaggtaggttccagacggagcaaactggctatgacccagacaaaatgggtgattaacaaactgaaggaattgaatccttcctatgactttgaaatccgggagattgtcacaaaaggcgaccgcatcctcgatgttacactgtcaaaagtgggcggcaaaggtttgtttgtcaaagagattgaacaggcgctgctgcatcaggagattgatatggcggttcacagcatgaaagacatgcccgccgttttgcctgagggtcttgtcataggctgcataccgaaacgtgaggatccgcgtgatgcgctcatttcaaaagggcatcaaaagctggacggcataaaagaagggggcatcatcggcaccagcagtttaagaagaagcgcccagattcttgctgaacgccctgaccttacaattaagtggatcagaggcaatatcgatacgagacttcaaaagcttgaaacggaagattacgatgctattattttagcggctgcggggctttcgagaatgggctggaaagatgatgtcgtatcggaattcctcgaaccggaccgctgtctgcctgcggtcggccaaggcgctcttgccattgaatgcagagagtcggatgaagagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcgggaaacgctgtgcggcgatgatgtctgaaaaaggagccaaagcactaatcgacagcgtgaaacaggagctcgaacaggatggcaaatgaccttcctttacaaggaaagaccgtgctcgtcacccggaacaaaagacaggcagcaccgtttcgaaaaaaagtggaggcgctcggcggaacggctgtttccgcctctctgatcgcttttcaggaagcgctcccggatgaatgtgcggacagtctgcgggaagacctttctgaaccgggctggcttgtgtttacaagcgtaaacggtgtccggttctttttttcctaccttgatcagcatggccttgcgcttccggaacggaaaaaaatcgcagccgtcggtgaaaagacagcgcgcgccctgaaagagcggggagcccggacggatgcgatgcctgacgagtatgtggcggaatgtctggctgatactttaaaacggcacgcatcagctgccgaacccgtttcattgataaagggcaatttatcacgcgatgtcataaaagcggagcttgagccgcttggctatcaaataagggaatgggtgttatacaataccattcaggatgaaaagggcatggacgagctgagacgggctgcatcccgctctcattttgattttattacgtttaccagttcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacctatacgattgaaggcatgctggacgtcatgtgcagcatgtcgggaaaggatagataatgatgaatcaaacatttaacagacaccgccgtttgcgcgcgaacgctgcgatgagagatctagtaaaagaaacacgtcttcacccttcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggcgtgccggaagaaaaagacgcctgcggaacccaggcttttcacgatcatggcattgtgcagaaagggattgctgaaattaaaaagcattatcctgaaatgatcgtcatcgctgatacatgtctctgtgaatacacggatcacggccattgcggggtcgtgaaagacggagtaatcctcaatgacgagtcgcttgagctgctggcgcagacagccgtcagccaggctaaagccggcgctgacatcatcgctccttcaaatatgatggacggttttgtcacagtgatcagggaagcgcttgacaaagaaggattcacgaatattccgattatgtcttatgccgtgaaatattcaagtgaattctacggcccgttccgcgacgcggctgacagcacgccgcagttcggtgaccgaaaaacataccagatggatccggccaaccgcctggaagcgctacgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagcggcagcccaaaacggctggattaaagaaaaagaaatggtgctggaaattttaacgggcatgaaacgtgcaggagccgatctgattatgacgtatcatgcaaaagacgcagcgaaatggcttgctgagtaacgatttcatttgacgggagctgaggcagatgagaagctatgaaaaatcaaaagccgcttttaaagaagcgcagaaactgatgccgggcggagtgaacagcccggtgcgcgcgtttaaatcagttgatatggacccgatctttatgcagcgcggcaaaggatcgaaaatttttgatattgacggcaatgaatatatcgactatgtgctgagctgggggccgctcattttgggccacacgaacgacagggtcgttgaaagcctgaaaaaagtagccgagaacgggacaagtttcggggcatctactgaagtggaaaacgaactggccaaattggtcattgaccgtgtaccgtctgttgaaatcgtgcggatggtcagctccggcacagaggcgacaatgagcgccctgcgtctggcaagaggatacaccggccgcaacaaaattttgaaatttgaaggctgttaccacggccatggtgattcgctgctgatcaaagcgggatccggagtggcgacactcggcctgccggacagcccgggcgtgccggaaggaatagcaatgaatacgattaccgttccatacaacgacttggaaagcgttgcactcgcattccgggagtacggtgaagatattgccggggtcattgttgaaccggtagcaggcaatatgggcgttgttccgccgcaggaaggctttttacaaggacttcgcgacattacggaacagtatggcgcgctgctcatttttgatgaggtcatgaccggttttcgcgtggattataactgcgcgcaagggtatttcggcgtgacgcctgacttaacgtgtctcggcaaagtcatcggcggcggtcttcctgtcggtgcgtatggcggaaaagctgacattatggaacgaatcgcgccgagcggtccgatctaccaggcgggaacattgtctggaaatccgcttgccatgacagcgggacttgagacgttacagcagctcacacctgaatcttaccaagaatttgtgaaaaaaggcgatatgcttgaagaaggcatttcaaaagcagctgcagcacacggcattccgcacacgtttaaccgggcggggtcaatgatcggcttctttttcaccaatgagcctgtcattaactatgaagcagccaaatcttctgatttaaagctgttcgccaagtattataaagggatggccgacgcaggcgtatttctgccgccgtctcaatttgaaggattgtttctctccactgcgcatacaatggaggatattgaaaataccattcaagccgctgagaaagtgttccaggcgatcagccgctgataccgaaaagccgatgcaagcaagacttgtatcggcttttttcaatgcctccattatcatattttcccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgatagggagctgaggcatgtagaggaggtgagggcgagggaggatggcacggccgagctcattcattgtttcccggtggacatcacgattccgaaaaataaagtgagccacctcaatgatgttttcgtatttattgatgcctttgattatcagctgacggattcaaggatcttaaccattcaagctgatttggcaattgaagggctgcttgaggaatccgagccgaaagagccggagatccctttgtacgtggcgcctgaattttccagagaagaaatgatcaatcttgccggacatcattctgaggacgaaaatgaaccagaattaatgatacgccatgagcctgaaatacctttgactgtatcagaagaagcagcacaagaaacagagaagaacgaggaagaaatcccgcctttactcaggcaggaggaagaagagcaggaaacagccccgattc

SEQ ID NO: 137 - DNA, 23279 bp, Bacillus velezensis FL50S
cgcatggagcagcgggtgaagcttttcacgttcagctgaattccggctttcaagctctccctgaagacgatcggacgcccaatacgtctgcctggcaaacgggtagcccggcagattgccgattcgcggcaaaggtccgccataaagcaagtccccttcgatttcataaccttgacaataaaaatctgccagcacgcataacagttcttgatattttctatggtcagaatatgaggcgctgcacttgccgagcacttctattatgtgctcctgaatatgctgtcggcctgcaaagtgctgcggtacttttcccgaaaacacataaggatgatgttcattaagctttgcctgcttccatacatacactgcgtcatcagcatcttgaaccacgatggcggcgcgatggttaaagtgatgccgtccttttagcaacgtatagctgagctgcgctagatcattttctttcagtccgccattttccgcccaagtgatcatatcttcgattttttcctgaagggcctcctttgtttttgctgataaagtcagtaaataagcaggggcatccggatgaggtgaagcgctgcgcttatagctttccataacgatatgggcgtttgttccgctcatcccgaatgcgctgactgcccccattcggtttttacccggcagagaaggccacgctttagccgttttattcacataaaaaggactcttctcccagttgatataacggttttccccgctgcaatgcagactggcggggatcatttcacgggagaatgcctgtaaaagactgatcaaactgacaatgcctgacgcggcaaacgtgtggccgatattggttttaattgatgtgagcgcgcaaaatgcttcttcgtttgtataggcagaaaatgcgtcataaagcgcgttaatttccaccggatcaccgagttttgtacccgtgccgtgtgtgacgatatattcgatatcttcagggttgatacgtccccggtcataaacggaagtaagcagccgggtctgcgcgacgccgctcggagcggtaattccgtttgttttcccatcataattgatgccgctcgcccgaatcaccccgtaaatcggatcgccatcttcttccgcctctctcagcggcttaagaacaaccgccgcggccgcttccccaggaaccatgccgtcagcccttttatcaaacgcgaagcatttcccgttttccgacagcattccggctttatctatcgtttcaaaaaagtccggggtattcatgatattcaccccggccgcaacagctgttgtacactctttattctgcaggcttaataccgcctgatggacagaaacgagccccgaggagcatgctgtatttatcgccatcacaggacctgataaattcaagtgataagccagccgcgccgccaaaataccgttatgatgagacgtgacattgcctttgtcccgtgttaaaaggtgataatctccttcttccgcccccacaaacataccgatcgtctgctgcctgatgtgactggcgccgtagccggcgtcctcaagggccctccacgcttcctgaagtagcagccgctgcttcggatccatcgtttcagcttccctcggcgatatttcaaaaaataaagggtcgaattcgtccgcccccggtacagcgccgagtttccattttgaacttgtgaagcctttttttgcgaccggtgcgacaacgtccttttcctgaaacagaatgtcccacagctcgtccgccgtgcgcgcctgaggaaagcggccgctcatgccgataatggcaatggaatcagctgcctgactgccctcggttccggcgttcagcttatttcttcccctctgcttctttcgcttttccgttcctgccttttcaaagacagattgatctgcggattcaggtttcttttcttcatagacatgctctatgacggacttgtgttccgtcagaaaatagcggacgaccttctccagtgtggaatgtccgaaaaacagggccggggtcacttcaattccgtagtgagcggacaaagaagaggcgaattccgccaaactgatagaatcaaagccgaaatcagccagattgtcagcatccgtcagtctgttcttgtctattttcaaaagccccgccgccagttccttcacatcccagcttacgcattcttccagtgtaaagcctttcatttcactccgccttcctgaaaatgggacgttcctgtttacagaacccgaattcggccgttcgccttgatctatctgcaggaagcgtttggccctcgacggaaaaccggccaggacgagatactggctggacggctggactaacaatgtttcaaaagcttcgagtccttcctctgtgtataaataacgctgtccgctggattttaaatacatatcggtgctttccgccgtgccgacatgcatccccccttctttccaaagcggccaattgattgcaagtgacttgccgcttctgagtccgaggctcacaagtttatcccggtggcggacaaaagccatttggaagcggttccccatcgcgtagtcacaagaaccgaagtctcctaaaatcgctgaagaagaagagaaacaacagaagaagtcaagcggctcccgtgacagaacctgatctaacaccgcggtgccgtccgcttttggcgataagacttgctgaaaggtttgcagatctttctccagaatgctttcagtgccttgaagacccgcagcgtgaatgacaccgtgaatcggcccgcatcctttctctttcgcttcttgcaaacctttctccatctgagcctgatctgcggcatccgcctgcacgtaaaacaccttggcgcctgattcttccaatctctttatcttgtgcagcaccgggccgcctgccgctgatctccccgtcaaaatgagcgtaaccggtcctttttcagcaaaatatccggcaaataacaagcccaaacctccgcatccgccggtaatcaagtacgtttttccgctttttatcacacgcttctcaacaggggcaatatccgtctgcttcatttccatgacgtgacggatttccccactgtacatgacactgcggaacgacccgctgtgaagctcttcacatacattatggatcagcttttcaaacggtcctttttgtccaaaataaaccgcggccgtatccgtctccggcaggattagtttcagcgaccgttccagcccgatccatgactcggcgtaactgatatcggtatcggtcccgcactgagcggaaagaaggatccgcctcggtttagaacgcaaagaagcagctgcacggatcacatgatacagaatggaatagtctttcacggccttttcatcttcaagcggccatccatacaaaacggcatccgccttgcctgcagccgtttcaatatgccgaaacgtttcttgatatgcttgtccgtcagtgattttaatttgataatgcgtgtttgaaagcttttgagtttcctcaccctgtgaaataaaaaacacgccggctcccggataaagggattgtaaagaccgataagcatgttttctggcagcttctcccgtaagaaaacagatgaccgttttcaactcttcatgaatggatttcttcagaggctgctgcgtccacctttcttcaaatatcatcatctcggagtgttcctcttgcccgtgatcctgctgagacggctgtctcattctcacccctttgatttctgcgcatacaatgccggtttcgtcacaaaattgaatgtcacagccggtttgattctttttattcatatacatccacatgccggatgaacacggacgcatgacgcgcagttcttcaaccgcttcaggcacgatatggactgacggctccgtttttgccaagacatgaaaagctgcgtccagaaattccggcggtagatgatatcccggattacggccgctttcatctgtaagagcaagcttcgcccaaatcgcattttctcccgcataaagcttttcaatggtgcggaactccttactgatcgttacacctgatgtgcctggtgtttcataatcgaatgacagcgggcggcagtctttttgtaaggaggcaatatcaagcatgcgggatggctgtatgctcccttgaccgatgattccataatgatgcagcttctcttcgtcactgtatatttcataacggatgccttcctcgtcttcagacagaagggagagattgacgcccgcaccgtgatgtccgccggtaatcgggtcagtccatgccgccgttcggatccatatctctttttcttcagagctgtctgccgcatgatgataagccgcaagcgccatttctaaataaacggctgccgacagaacccgctctcctctcacatcctggaaaacgtgttcccggcctgtaaaagatgtatgatagctttgctccgccaaggttgacgtattttcatgcaggaaaggatgcacatattcagttgttcctgtttttggttcttcccgcttcatccagtagctttcttttgcaaatggataagacggcagactgatacgatgcggcagcgcgcctttatataaagatgcccaatcgacgggcgccccgtggacccaggcattcaaaagactgccaaattgacgtttttccatccaatcatcgactgtgccttccgtctctgtgacagcactatcactccggcccgtaaacaccccgcttacggaaccggcattattcagaaaagcagtcagcttctgttccaattcagaaacagagtccgctgtcatcgccagccgttcttccatcggaaccctgccgacttgaagggtaaatgccgcgtcaagcaggttcgcatctgtaattgttccgtttccggcggcatccgacagcaacagagcccgctcgcgcaagcggtctttatcttttgccgataaaacaaaaagcgccggacggccggtgtccgccgaagtcatttcagccggttcatactcttctatcagcaggtgggcatttgcaccgcccgctccgaaagaagatgtacccgcgattctcggatattcccgtgttactccttcagattctatgaccggccgtctccattcctccgtttcctgctgcacgataaaaggagaagtttcaaaatcaatttccgggttcagctgctttgaatgcagcgacggcaccagatatccgtgtttcatctgaagaagaattttggtgacggcagcaatgcccgccgcactttccaggtgtccgatattggatttaacagaaccgatggaacaaaattgctttgcatccgtatagcggcggaaagccttggttaaccccgcgacttcaatcggatctcccaaggaagtgccggtgccgtgggcttccagatagctgatcgctctcgggtcaattcctgcccgctccatcgcgtctgcgatcacttccccttgtgcattcggattcggaacggtgaacccgttcgttttgccgccggcgttcagagcgcttcctttaatgacaccgtatatatgatcatgatcttcaacagccttcttcaacggctttaacacgatacagccgacgccctctccgtcaacaaacccgtcagccttatcaccgaacgctttgcacgcgtttgacggcgacagcattctcatagaagacagtccgatataatgaaccggatctgtaatcaggtttacgccgccggcaatcgcgcattcagatgcacctgttctgatgctttctgcggcgagatgaatggcggttaaggatgaggagcatgcggtatcgaccgcgatgctcggaccgtgaaaatcaaacacataggatacgcggttcgggataaagtggtagtgggcccctgtcggatagttgccgttcatgacacctgcaaaaacaccaacctttttaccggcgcatagtgaatcaggggtatatccggcatcctcaagggccgcataagcggtttccagaaacagtctctcctgcggatccatgcgctccgcttctttcggggagattttaaaaaacagcggatcaaatttatcaatgtctgttaaaaagccgccccactttgtatacatccggccttccttaccttttgtctcatcatagtagtcccgccaatcccagcggtctttcggaatttcggtgattccgtgttcaccggtttttaaccgttcccagaactcattaacattttcagctccgggatacttcccggcaagaccgacaattgccacttcatggtgttttgacggcggttcggaagcgggcggcgctttttcagaaaaagatgccgcttggcgcttcgtcaatccggcgctttttttgcggctttgctttttctgtagagtgtgcggcaccttttcggcttctttatttgtcttgaaaatcccagccatatcttcctgtcttgagctgacgagatattccgctaatccgccgattgtcggatactcgaagaacaatgtgctgctgatatcagggacgtcttcccgcacgcggttggtcagctgtacgattaagatggaatcaattccgtattcttcaaggggcgtatgggcttgaacgtcctcaatcggcatctttaagatgacgctgacgatctgtttcagatactctgtgcttttttcaagcaaagagcctgatgataccgcttcagtatgacggacttcttcagaaaatcgcgcaagcagttcgcgctccttcgtttcagccaagtatgcggcaagctcttctatcgttcggtgttcaaaaaacagcgtgctgctgatatcagggacgtcttcccgcacgcggttggtcagctgtacgattaagatggaatcaattccgtattcttcaaggggcgtatgggcttgaacgtcctcaatcggcatctttaagatgacgctgacgatctgtttcagatactctgtgcttttttcaagcaaagagcctgatgataccgcttcagtatgacggacttcttcagaaaatcgcgcaagcagttcgcgctccttcgtttcagccaagtatgcggcaagctcttctatcgttcggtgttcaaaaaacagcgtgctgctgatatcagggacgtcttcccgcacgcggttggtcagctgtacgattaagatggaatcaattccgtattcttcaaggggcgtatgggcttgaacgtcctcaatcggcatctttaagatgacgctgacgatctgtttcagatactctgtgcttttttcaagcaaagagcctgatgataccgcttcagtatgacggacttcttcagaaaatcgcgcaagcagttcgcgctccttcgtttcagccaagtatgcggcaagctcttctatcgttcggtgttcaaaaaacagcgtgctgctgatatcagggacgagatcccgcagctcgttcgtcagctgaacgatcagaatagagtcaatgccgtattcatccagaggagccagcggatttatctcttctgccggcatttttaatacttttgccgcagcccttatcagaaaagcagctgtcttttccgaaagcccttctcccgcttgtttgatggggagctgacgatcagaggatgttcgcggtacgtttgattggcgcttttgcgcggtgtaagcttccctgctctgcctgatgactccgttgcttttcgccgtgataatctgctgggtgtgcagacgttcgttttcagccggaaattgaatggaatgaaagccttcagccattaaaaccgatttccatgtttccggataaagaccggggcaccccggaatccgcaacgcctcgtcttcgtacagccaccagccctctaataagccgaatgtaacatgtgtaaacggcgtatgtccgcccagttcattaacgagcagcaaaccgtcttttttcaatacggcttttgccgtccgtaaggttttccggatatttttggtggcatgcagcacgtttgcggcgatagcgatatcgtaggttctcagatgtaatccctggcccgccgcaggcttctccacattaaacagctgatacgtcaaatacggattgtccgcgccgtattccttttcggcatgcattaaaaaagcttttgacaagtcggtataacagtattcctgaatatggttttgataggggcggagctttttaaacagtgtgctgctcgttccgccggtgcccgctccgatctccagcagacggatgtttgcctcaggattgtttttaattacattttccacataaatacacgcttcatttgccatcacatcgttgtaataatcagcgagaatgttatgcttatagattccttcaacgagctccattgaagaatcgggaaacatcacgtcagtggcttttattttgcctgttaaaatgtcaggcaaagcttgaatgacggtatccgccagcagagcctgcgctttcatatccggatctttcagccattcgtttttcttcttatgccactcttcccaaatcgcggccgtttcaccgcttttaagatcgctgtctaaaagacggatgctttcttccagccagcgctcatataaaggcagacaggaagccgccggcgcttcgccggtcagacccattgaacgcagcgtcacccgcagcacttgcagcaaaagccgattcaattctttcatttgattgcttatttctgttcttaaggataactgtgtacggtctttttgtttgtctcccttacccaaaaccttatcctcctaagaaaattaaatttgctccgtcattttgacaggcaatcagatagtcacaaattcatgagggttcattccctcgatcggaatcggcttggtcagcttcatcagccccatgcgggagatcggctgcgtcagcagagtttccagcgcctgcatcccttccgcccggctgatcagtccgagaccgattgcactcagtctgtcaaactcttcagaaatgtgattgtcagcccgctcccaatacccccagttcatcactttgaccgggcatgacagccgcccggaaagctcatgggcaaatgcgtctttaaatgcgcaccccgccgcataatgactttgattcggattcttaatatatgaaataaccgaagagaaaaagagaataaagtccaaagactctttcgcaaatacttcggcaatgttgacggaaatatccactttcgccgaaaggccggcgtgaaactgtgattcttccatatcttttacgctttcattcgcaaataccatcgctgaatgaacgacgccgctgatggtgccgtatgtgtttttaatctgttcataggtgcgctgaagcgatggaagatcagaagcatctgctgctatatattcgggagccgggcctgatggccggtaccggtctattttttggcgtatccggctgtccagcggccgcctcccgatccagacgactcgggctttatacgtcgtcaccatataatctgtccaaacctcgccgatgcctcccgcaccgccgatgatgacatatacgcctccatatcggtaaggaacactttcagacggcccgctttggaccggaagcaattgaggccggtgccattcctgatgtctgcgcacccatgctttacccgtacggtcgcggggcaggctgaatatgtcttctgcggggaaatcccccccgtcttcaagatcgaccagacggatgtgccagctcggatgttcttttgcgagagacccgacgaaaccgtgcacactggaatgagcgggacgcacctcatcatattgggtgataggctgtgcttggtgcgtaatcaccgtcatcccgagctgctcttttccatacccgagaccgataagagctttggccgctctgaaaatttgcagcaccccgcttttttgatcatggatgtaagaatcagccggctgaggggcaaaccagatcatatgctgaatctcaccgagacggcggagccgatcggatatcacttcaacggaagcactttggctgctatcaaatcgcacagctttaggaaacaatcgtaaaaccgcgtccgcctgcccgtctgtaccgcctatgatgacagcttttgcttcagaaatggggaagccggtttggttgtctatcgattccgcgtcccatacctgcatcagtttgacggctccggtaaggttacccggcagatcgtattgcttattatcggttacggtcggcgcactttcggccatccgggcagaaaatccttttattcttacacacacattgccgcgttcatcacatatatcaatgtccattcttcgcacagccggtgtttcatgcgtcacaaacacggccgcccacatgtttggactgcacggatgaaaaacggtcagttcatgcaattcaaaaggcattaacggctgctccggataacccgctttatcttcattcataacgccgatggccgcctgaaaagcggaatcaatcagactcggatggagcacaaactgttcggcctcatcacaaacggaagcagggagcaccaatttagccaaggctactttttccccgcaataaatgtgatcaattccttgatgtgaaggtccgtatacaatttccgcctttgcaaatgccgcatagcagtcttcttttgacagcacttttttgcggcagcgtgctttcagctgttcaatatgcaaaaccggcgcctcagacagcggctcaatcacagcactgccttcacaataaatgtctgaatcgttttcattgctgtacacttgaaatgaaacattgccgttatcctctaaggaaagacctgtcgtcatacgcagcggctcttttttatgaacggcctggcgtatccagctgatataccgcagcgaaatgccggttttagccgtgtattcagcggctaacggcgcggcagccagttcagccgcggctctcgccatttcaagataagccgccccggggagaacacacttgtttcggacgatatgatcggctaagaagaattcatctccgttcagtaccgtgctgaatttttgttctaacaaatctgatgtattgcggtgaagcagcgggtgaagcctgctttctgtatttacggaagtgacgggatgatcgggctccggtatccaatagcgttccttcgcaaacggatatgtcggcagactcatcctgcgcggtttctcctccagatacagccgcgtccagtctatctcaaatccttttgaccacagctccgcaagttttttgtaagtgccgctgtccgtccattttcggatcagctcctccgtatcctgatcatcattcaggaaacccctgatttccgttccgctatcagaccggccttgaaagcagccgtcaatctgccgttttcgttctgtaaattcggttaatttcctgatcaggtccgcttgatcgttcactaaaaaaacaagccgttcttccattgccagccgtcccgtttgcagcgtatacgccagtgaccgcagggaaaaaggttcatcagactgcttctctaatccggactgaccgaaaagaccggaaagaatattcttatgtttctcatcgtttgtcagacattctgctaaagtccggacggaagtatgctgtatgagatcagtcatgtctattgccagcccgtattgatccgtcagccgctcagaaaactgtgtcagctgcatgacatccaagccgaattccttccaatcctgttcaccatctaccgagccggcctctacatgcagaacttcggccagagcaccgcgcagcgcattttccagctgattttgcattgtatctgttttgtcatgacgcggcccgcttccttcaagcgctttatctttgagaaacatcagcaggcgggcagcgtattccttcagccgctccggatttttcgctgatagaggcacgatatacggtctctcttgattctccgtaatgccggggtttttgggcctgtactcttctaaaatgagatgaacgtttgaacccgtcgccccgaatgaactgatgcctgcgcgtctcggacaggaatgttcactgccgttctctgtatacgccggctttttccatgactcggttttttgctgcacgtaaaatggcgagtcctctaaacggagatacggattaatcgtctctgagtgcaaagaagggacaagcgttttgtgaaacagctgcaaaaccgttttatgaagcccgctgattccggcggctgattccgcatgtccgatattcgatttaacggaaccgatcgcacaaaattgccgatcctccgtaaacgtgcggtaagctttaacaagaccttgtatttcaatcggatctcctaaagaagttccggttccatgcgcttccacataagaaatcgtcctgggatcgatccccgtcttttcaagacattcagctatcatatccccctgcgccactgggctcggcacggtaatcccgctgacggttcccacgtgattgacggcgctgccttttatcaccgcataaatatgatccttatcttcttcggctttgtgaagcggcttcagcagcacggccccgatgccgtcagctgagacatagcctgtgccgccttcgccgaacgtgcggcacagcccgtcactcgaatgcatatccatcaagccgtatgtgatatattttgtcgggtgcaatgataaattgacgcctccggcaagagctgcttcacattcaccgcgtctcagactttccgccgccatatggacggccgtcagagatgacgaacacaccgtgtcaaccgccatgctcggcccgtgaaaattgcagaaatatgaaacccggtttgcgatcggcgcatagttcaagggataaggaaagaccagccctttggccgcagcttcagcgccggcgagagaataatccatatgcatcaccccggcaaacacaccgacgttcattctcttattcggccctttcggctgaacgattgtttccggggtatagcccgcatcctcaatcgtttcccagcatgtttctaaaaacaatcgttcttgcggatctttagcttctgcctcccgcggagaaatccggaaaaatttcgcatcaaaacaatccggatcgtctataaaaccgccccatttggaaatcggcttgccggacggcgatcgcaaatgctcatatttcctcgtatcccagcgggaacgaggcacttccgttacgctgttttctccattttttaaatttgtccagaattcacgaagatttttggcgccggggtaccgtcccgccatcccgacgatcgcaatatctccattctgcgttccggctgacgccgattttttcacgcggatttgggtcgtcctctttttttcccggtgcaaaggttcagcatttgaatgcccgctttgagcatggccgaagccggctccgtaatgttcgcacaaataccccgccaattccgcgattgtcgtgtattcaaataacagcgtcggcagaagctgcgttccgatttttcgttcaatttcctttaccatgtccaacagccccggagaatccagccccatttcatagtagccgatatccgggtcaatctctttcacaggtttgttcaatcgggcggcaagcaattcttttaaataaaggatgcactgttcagtaaggccggcggaagcctccgcacggcggggctcggaaggcgccggttccgcttgcggagccgggacggcattccgcccgtcaggttctttcttttgccgtttctgattgatcagttccgggtccctcacccgtttattggcgaagtttttcagttcgccgacttttctgccttcctcattgaaaaactccattgtcacgtaaacgagatctttcttacgggtgagggattctttttttatcttggtgatacatgtcgtctgcagcaattcggcgcaataaaacgattcataaaacagcggcagaaataattgcccatcctccctcgtcaaaggagcgagatatacattggagccgatgctgctcgcatctatcaatgcaggatgaaacatcgcctcttctgcatggtccagctgatccttttgcaccgacagatcaatataaatctctttttcagtctggtagacgcttccgcagcctttcatcattcctgaatgaaccagttcttgatccctgcattccgcgtaaatatcctcaagcggtatttctgccgccgtttgttttacggcatccatccggacgctctcttggaagccggcgggcttgacggaatgcatttgcgccgcggcatatatctttttctctgctgcttcgtcaccttgtttttgccctttcacctctaccttccactgcccttcgccgttctctgtacagtcaacggaaagcaggattgtttctccctgttcaggagctaaagggtgaaaaatcgataagtgcctgagttcaaggccggcatgaaaaaaaccgttttctctgaaagtctgatagatcaggtcaatataagccagacccggcagcagttcctttccataggctttatgatgtttcagaacgggatgctgattgttaataagaagctgctcttgcatatgaacttcctccatatcgacgttcaattttcagcgcaatcagtaagtcttcatttgtttccaaaacgtattcgggcgggattcatgtgcgttttcatgcaggttttcagctttgtccggacggatgggccggcgttttaattcctgtctcggcaaaggctttctaaccggggtatacgcctcctgctcccaggcttccactatgacatgggcattcgtccctccgtcagcgaaactgctgacggcggcaatccgcggtgaatccgtccattcacgcagaacgtgcgaaaaataaaacggcgaggcggacagatcgtaatgcgtcatcggctctttgcccgaaaggaaaggcacacgcattcggcgcgagagcataagcactgttttaatgaatccggcaatcccttcagcgcataacgggtgtccgatattcggcttcatcgaccccaattcgcaaggcgcgctgttttgcatacggtacaccgcttcaatcgccctcagttccaaaaggtcggttacttcagagcctgaaccgtttgcttcaatgtagctgatatcctccgcttttctgccgcttttggcaagcgccttggccatcacttctttctgcgcctgtatattcggtgtggcaggccccgcggttctgccgtcattgtttacggaaatgcctttaatgaccgcatgaatccggtccccgtcttttacagcctgggccgctgtttttaaatacaccattccgacgccttctcccaatacgatgcctccggtgcggcggtcaaaaatatgaaacgcaggctcttcgcttaacagattgcgaagttcgaacatccggtgggtttgaccggattccagcagactgactcccccgaccaccgctgagtcgatttcaccgcaagaaagcgcctgtatcgccatattcataccgacaagcgctgaagaacaggccgtatccaaaacgagactcggccccttcaaatcaaagaactgagaaagattggccgccaagtaattcgggccggcggcgactatcggattttttgcatgcttcagacggttttcgtcaggcatactgccgccgcgtcctcctaaatagacaccggctgacctgcctttcatttcttgtaaagagtaaccgctgtctctgaacagatgaagcgcctcttctaatataagaaaggactggatatccattgccttgatgtcttcttcgggaataaggaaaaactccgggtcaaaatgcgttacattttttaaaaggcccgcataatccgccttctccgttttccagcgttctttcggcaccctttgaatagccgacgacccttcagacagcagcttccaataagcttcaattgattcagctccaggaaaacggcaggacattccgacaacagcgatgtcttgcgccgctgcagcgccagaaggctgaatgacagcggctgctgtttgtttgggaacgtccgggattacaggctgaaccggttttgaaacggcagctttgatttccggatatgccgtttcaagccatcccgccagcgcagcaaccgtagggtattcatacagcaccgccgggtcaaggtcagctttgatcctctttccgatcgctctggacacttgggcaagcatgatagaatcggctccgtaatcttgaaacggtgtatcagattcaaatcttgacggctccagtcttaattcccggcagcaaatgcccgtcagccactcctctacgctttctgtctcaccctgtacatgctgctttgtttcggtaaggccggttgaaagcatcagacggtcgggctcccatttttccgggtgaatgacggccggcataataacagatccgcaatcgcctgccataacggcatcaaacaggctcagcccatctctgtcagtgatgctctttaaaccgcttttcagatacgcccggctttttgattcgcccatacccgtttctttccagctcggccattggatgctcagcaccggaaaaccttttgcggccgcaaaataatccatataggcgttagccatggcataatcgctttgtcccgctcctaattccggcatcacgccggacactgaagaaaacagcgcaaaaaaccggagaggctccttgtgcagcgcttgatacaaaaggtccagtccgtctgttttaggttcaagcacgggcatcatctgttctctcgttttgcggataaaggctggatgatcgagatctacggctcccgctgcgtgtatcacgcctcctatcggccccatcttctctttcacccggctgacggcctgctcatattcagggccggaagatacagacagcacttccgttcggacgcctttttgttcgagctctctgattcttctcactttatcggaaaacggggaattccgtttgatatgatcatcccactccgctttcggaggcattgtttcttttccggtaagcacgagtttcgtgactccgtaacgttcggcaaaatgccgggcgaataaatatccgagtccccgggtccctccggtgatccagagcgcatggtctttcggaaatgaaaattctttttcagctaagctgtttgtttcctttaaccgcgcgtgatagcgcacaccgtttcggtaacacacttcgatgtctgcagaatcgcgaaaaaactcctctgcgatctggtttgccagctcggaatcttcagcagtccgttctgcatccatatgccgcgagcggatatccttatactcactttggagcatccggtacaatccggccttttttgcacctgagagatttatcgtttcattcgcaaaaggttcaagcccctttgtcacacaaagcagctgtagctttcggccgcggtttctgttgtcgatgagagactgcagacgatgaatccagccgtcatcatgcttgatttccgtcccgcatcccgtcacatcaatcagaccgccaaaccgggccgcgtccccggatatttccggtgatgcagcgtcaatgatttcagactcggggaaataacgggacagctcaacggccaaatttcctgtctggtgatcagcggctattccgatgacgccccgcacttccttagccggaacacggctgctttctgcccagcttttctgtaaaaagcggaattcacgaaatgtttcagaatgtgtttcagcaccgcgaacattgtccggcgctgcatcgtccggccaataacgatcctttataaatggataaccgggaaggctgacgcgatgcggcaggctgccgttataaagctctgaccaatcaatcttcagcccttttacccaaagttccagaagcttcgcgaatttttttcttttcatccatttacggacggcttcctgcatatcttcatccttaaaaacggctagaatatctttatactgtttgctttttcccctgaagcagccgtctgttccgccgtcaataaaacgctgcagtttttccgctaactgctctgtcgacgtcacgataaacgccgcacgttcttccatcgcttctcttccggtttgaagggtgtaagccgcatcccggaggctgcggtctgtgacgtcattttttctgatcgcttgaagaagctgctgcgcccgctgcttcaggctggcctcctgtttggcggataataaaatgactgcgggatcttcatctgtgaatggctcagaaatctccctatcaggttcaatatattcttctatcaatatgtgggcatttgccccgcccgcgccaaaagaagagattcccgcgattctcggaatctctttttgcgctccgttttcctcaatgaccggccgtttccagtctgccaattcacgctgcaccgcaaacggcgtccggtcaaatgcaatattcggattcaaacttcggcaatgtaatgaaggggccagctttcgtttttgaaactggagcagcagttttgttacaccggcaatgcctgccgcggcttccaaatgcccgatattggatttaactgagctgatggcgcaaaagcctttatctgacgttttcgtttgaaatgcgcgggtcaaaccgtcaatttcgatcggatctccgagttcagtgcccgtgccgtgggcttcgatacagctgatcatccgcggatgtattcctgatttttcaagcgcgccggaaatcacgtcagcctgggcgctcggactcggcactgtatacccgtttgttctgccgccgtgattgatatgagtgccgcgaatcaccccgtaaatatggtccttatcagccatcgcttttgacagcggctttaacagcacggccccgacgccttcaccgggaacaaatccgtccccgccttcaccgaaacttttgcacgttccgtcttttgaaagcattcgataggcgctgagctccgcataagccgaaggatgcgtatacacattcacaccgccggcaatcgccatgtcacatgcgccgcgaaggatgttttcacacgcttcatgaattgcagtcagcgaagacgagcacatcgtgtcgatcggcatgctcggccctttcagattaagaaaataggaaactctgttggccgctgaactgaacgacgttttcggctgcagggtgccgccgtttttccagtacattccgtacccgtttttcgtaatgccagcaaaaacgccgacccggccgttatacagattctcaagctgttccttcgtataaccggcatcctccagcacctgccagcacatttcaataaagagacgctcctgcgggtccatattcaaagcatcacggggtgaaatttgaaaaaacagcggatcaaagaaagcggcatctttcagaaacccgccccgcttactgtaacttttccctgctttcacggccgcttcgggatctgggttgtagtacctgtccttttcccagcgctcttcgggaatttcggtcacacagtcttttccggccgctaagttatcccagtactcttcaagtgtttcagcttgcggataacgtccgctgactccgataatcgcaatcccttcttttgtctgtttctcattggaaaaagcaggccgttttcttcgcttggtaaacgacggaagcaccggaaaatcttcatttgccaaaacctgttctgatatgcctgaacggtgctcatcatcatttgtccattttcggcattcattcggataatccgtgacaaagtgagctgccaaagagcccagtgtcttatattcgtaaaaaaccgttttggaaaggtcaccgaaaagcagagacaattcgcggttcaatttcgtcacagtgactgagtcgattccgtaagtttccagcggctcttcagtatctatgttggaaacagcaatttttgcagtcaggccaaaaagcgttttgagctgaagaagcgtttgttcatacaaacgttcactgcggtgttcggcattggtttttccggaagcgcccgtcttgatgacaggctgcagcttcaaccccgacagagaagcccatatttttccttctccgtcacataaatcaatataaaagctccccgccttctcttgtatctcggcccataccttgtcaggacaagattcataaaacaaaagctcgtccaatgaaaccggagcgagcgttttatattctttgccgccaagcagcgcgcatgcctctgtcacactttgcatcacacagggagggaggccgaatcgggcggattctttttggtttgtcaatggaattgatatgtctgccagcatccgtcctgatgaagcgtaaatacgctcaattcctttcatgtgctcactgtattgaacggtatcgttctgagtgatggcttcaatttgctgcttatccatcagggaaccgctgttttccttcaagcggctgatatccagcatgccgggcgcagcatcaactggctgaatcgtcccttggctgtacacatcataatgactggaatcagcagaaaatggattataaatctcaaaccttttggcttcaccctctgcgggtatcagcctgatttcgatatggaacggctcagcctcagtcagaatgggctttgaccacacgatatgcgtcagccggacagccgcagtctcctttactgtcaaaacagccgcagctctcgccatttccaaaagaagttctccaggcataagctttttatgctgtaaagaaatatcagcgagaaaaaattcccggccgctgaaagctgccgagaatccctgtcccgtttcatcggaaatatgctgctgagcaagcggatgaagggaatccgcttggcgaagtcccatccgcatatcataatcacgcaaaatgccgatcgcatcctgttttgtcatttttttatttttgacgtcagaaaaaacccggtgcagaaactctttcatatggtttcctccattacgctaatccctgtaaaaaccgatcgttctttttacagcggcttctatgcttatttcgtttttctccaattcatcaagcaggcgttcataagtctcaagcggggacgtatcagtcccgtaagtctcccggtgccttatatgctgcgcactgtgcggtatccagcaatgtgttttcgcaaaaggatagacaggcaggctgacttttttcggtctttcgtcctgatacaatttactccaatcaacatgcaagccttgcacccataattttgcaagcattgcatactttcctgcttcaatccattgatctacggccccgctcatttctgcattgtccgtcatctctgtaaacagctgtttcatcgctttgttccggcctgtaaagaaattctgccccgtctccttgccgctgaggaaatcattcagcgcgttcgtaagctcttcttttgtttcagcaatgacggcaaggcgctcttccatttcatcccggccaagctgaagcgtataagcgatatccgcaagagctccgtcagctgaatgtgacttttccaaatatctgcgcagctgttccgcacgttccttcagctgttccgccgtctttgccgagagaatgaataaggacggctgaagttcaccggccgtccattgtttctcttcaacaggagaaacatattcttcgagcacgacatgagcattgacaccgccaaatccgaacgagctgacacccgctctccgcggcagttcatttccgctatcatcagtcgccgctttccacggctgagtttcgcggacgaaataaaacgggctgccgtcgaggctgatatacggattaacggtttcacaatgcagacttttaacgagcgttttgtgctgcatctgcaaaataatttttaaaagtccggccatgccggcggcaagctctgtgtggccgatattcgttttgacggaaccgaggccgcaatgaggctgatcgggtgccgttactccggctttctgataaagcgctgcaaaagccgctttgagtccgttgatttctatcggatctccgagcgccgttcccgtgccgtgggcttcaatataactcactgtacgggggtcgatgttcgcttgctgatacgcttttatcatgacttctgtctgcgctttcggattcggcgatgtaagggaagccgcccttccgccatgattttccgccgttccgcggataacggcataaatacggtcgccgtcacgttccgcatcagataatgttttcaaaacaatcatgccggcaccttcagctctgacatacccgtccgcttgatcggaaaatgttttgcagcgcccgtcttcactgagcattcctgctttattaaagctgatatgcatgtccggcgacacaatagcattgacgcctcctgcaatcgcgatgccgcagtctccggcctgaattgccctgaccgcacggtgaacagcgaccaatgagcttgaacaggcggtttcaatcggttcgctcggcccatgtatattcagaaaatagctcatgcggttcggaccaattgacggaaccgttccggcggcggaagaaccctcaatctctatatggaactttgaagcttcctgggcgtaaccgctgtttgtcgtgcctgcaaaaatgcctgtatttgtacctgacaggctttttgcagagcagccggcatcttcaatcgctttccatacatgcatcattaaaagtctttgctgaggatccatcatttcggcttcatgcggagaaataccgaaaaataatggatcaaattgagcggtttcatcaatgaagccgccccactttacattgctcgcatttttatctttctgcgggtctccgtaatactgtctccagtcccagcgctccggcggtatttcagaaatgcagtccttttctccggctaaattctcccaaaacatttccggattttcagccattggaaatgcacagctgattccgattatcgccacgggctcttcaggtgcagctgcggtttttgttttaggaaggcgggacggaatcgagaatggctccgtcttcatttttttacgctcaaccggtttctccgtttctgtttcttcctgtgggccgaatgtatccggatgttccgtcagcaagtattgggcaaaactaaagactgtcggatattcaaaaaacacggctggcgtcagttcaagcccatacattttatttagttcatttgcaaactgcgtgaatgaaactgaatcaaatccataatctctcatctctgattcagcatctatttcttcttctttcaccttcagaatgcctgatatcatatgtttgagttccgcttgtactttatttggcagatggacgtgggtcttccttgacacatgaatgctgcgtgacggttccggcgcttcaggcatcaggttttttcgaatccgtttctcgtcgccttctgccaccatgacctggtgtgctccggaggcaaaagcggcgt

SEQ ID NO: 138 - DNA, 21173 bp, Bacillus velezensis FL50S
cttttttatgaaatcagaaaaacagccggactttcaaaaggaagtgaaggtccttgcgaaagaagcggatgagcaaaaacttgtttacggtatcgtttatgaaccggacacagtggatgctcacggggatttcatgacagctgcagaaattgagaaggccgctcacggcttcctgaaagatgctcgtgaaattgataagcagcatgactttcagggcggcgttggtgaagtggtagaatcttatgtcgctcctgctgattttgaaatgaatggtgaaaccatcaaaaaaggatcatgggtgcttgtgacaaaggcctccgaggcagtttgggatgaaatcaaaaagggcgagattaccggttattcaatggccggcatcgcagatatcgcaaaacaaaaagaaaagcctgtttctccagaggacaacaacgagaaagggctttttaatttggtcaaaaacttttttaatgccaatgtggccaagggcgcggttcgggacaaatatgatgaggggcgccaacgccgtgagttttgggccgcacaagatgcgttaaactcagctttattcaaatgggactatcccggagagatggaaaatgatcctgcaaaaatcaaagaagctctgcaagacttcgtggatatcgctcaggatgtattgatttccgatgacattctaaaagcgatcgggccgaagccggcagagctgcagaaggccggccggaaattatcggctgctaatgtacaggagcttaaaaatatacaggattctatcggcaacttgttaagccaagcagaagtaaaggaggaagaggaagagatgacttcagaagacgtaacaaaatccatcgcagaagcattagagccaattcagaagcggctcacggaattagaaaaggatgaagatcctaaaaagaagaaagacgaggaaaaagcatctgaggaagaagaggctgaaaaagaggctgagaagttgaaaaaagccatcacagacgctgttcaaccgctcgctgatcgtattgatgccattgaaaaaagccgcggcgtttcaaaacaagaagagaccacgcaggaaaccgcagatgttaaaaaatcaatctgggccggccttctttaagcagaagcggcaaacacaaggaggatcacatgagaaatcaagaggtaattgaaaaggcagagatgacgcttgccagcttaaagagcggcggcatgatgaacccaacacaggcaaatgcatttattcgaatggttcaagatgcgccgactatcttaaatgaggcgcgtgtcattcctatggatcatgatacgcaaaaaattgagaaaatcgggtttgggcagcggattctcagagctgcccaggaaggtgtttcgctgacaaaagatcaaaaggttgctccgacaacaagcactgtcagcttgagcacaaaagaagtcattgcagaagtaaatatcacctacgacacacttgaaaacaacattgaaaaagagggactgcaaaatacaattatgcagatgctcgctgaacgtgcggccgttgatattgaagagctgttagtaaacggtgatacggcatcttcagactcatatctcgcgcaaatagacggaattcgaaagcaagccacatctcatattgtggatgtagcgggcgaagagttgactcgccaggtcttcaagcgtggatataaagcagttccttcaaaatatctccggattccgcaggagtaccgtttttatacctctcctggcatggaagttgaatggaaagaccgagtggctgaccgtcagacttctttaggagacaccgcggtacagggcggactttcttcagcgtttggtgttccggtcaaaggcattgccaacttgcagccgtacaccacaggtgaaggggatagcgcgtcagatgtgtcagatattatcctgactcacccgaaaaatatcattctcggtttttcgcgcaacattcgtattgaagtagataaggatatccgccgccgtatgttcgtgatcgtcctgacggctaagctggacagtaaattcgaagaagaagacgctgtggctaaaatcatcaaagtgaaagagtaggtgaataaaatatggccgacacatatacagcgaagttgatagcaggtcaaacttacgatgttatggggtatgtcttcctgcttaatcagaagcgtgaagtggagaagcccgtctattcttatttgaagaataatgagcagtttgagtgtcatttaattaaagaagagccgaaggaaacggaaaaacctaaaagcgatgatgacacggcaacaaagaagaagtacacagaaacagatttgaagggcatgaataaaactgaacaagaagccattgttactgatcttggcggcaatccgtctgacttcaagaatgcagatgaaagaattgccttcatccttgaacaacaaggaaaagaagagtgagcggcatgttaattacccccgctgacttaaaggcttactcggtttttgattcagtcaaagatcggccggacgtgctgcttacccaggacatcatagaagccgttgctgaaatttcgttagaagttggccatgatttttcaggagaggaatatgatcctcttcctgaaagggtcaggctggccgttttaaagatggcgcagttttacgcactgatcaattcggatgagtcaatcacaaaaggatatacgtccgagaagataggcgattattcgtacactctcggcaatggaagcaccattcaaaaacccaatatctattcactgatcaaggattacgtggtgccggctgattcagatcttgaaggcacagaagtaaaaatgcggatgaggtctatatgagttaccgctccttactgacgcacaggtgtgatgtttaccatctgcaggagaaacacgaaggccaagaaaagagatacggcgtgcctgttcacgatgcaccgccggcttacacttatcctgatgagcctgatataaagagtcagccctgctattttactgagaagagccagtcaattgttcagcaggagccgaacgcggccatctaccagtcatttatgattcatttcccggcttctgcagatattcggatcaatgacagagtgaaatgggaaggcactgcttacaagctgcagcagccgcgtttgattaaaaatcaccatttggaagtgacggcagtcagggaggttaattacctatgagaattaagggtctcgatcaattcgttcaagcgctgcaccaggcatcccacggaggactgcggcaagaatatgagatgtggcttgaaggaatgggttatcaattccttgatattgtccaggatgaagtgatccagacacagacggtagacacgcgccgcctgcttaactcattccataagggcgatcaggagaacatcttttcaatgacggctggtaaattaaagctggatgtgggaacgaatctggattatgcctcttatgtcaatgacgggcatttcaccattgatccatccaagaatcaggatcgtcgctgggtgccgggccgatggaaaggtgaccgctttgaatatgatcctgctgaaaaaaactccggaatgctgctgaagttcaaatgggttgacggttcggggtattgggataatgcaatggccatctttgaaatgatgtttgagcgtagccttgagcggaagctccagcaatggattgaaaataaattttaggcggtggcagcagatgaatagtgaagttggctcaatcatgggctatctatacaatttgtatcctgtccaggtatatgaggaagagataccgcaagactttgcggtcccatctctttacttcccgccggcttctaccgccgacggtccagacacagtttcaacatttcagaaagtctatgtgctaaacgtgaagctatttcacaaaaatgctcagaaggctcatacagaagctgaaaggatagcggatgtccttagaagtaagagggggctaatcccgctcctgaaggaatctggtgaaaatacgggtgattttatccgtctgtcacgaattgaaacccgggtgacggatgattatgcaagtattgtcctgaattggacagaccgctattggtatgagagagaagaaaagccagctctgaataattttgattttacaagcggggtgaaatgatggccactaagttagaaaaagcagaaactgctttctatatcaaggatttgagggggcacagtcgtgagctctttggggtaaagcccgaagtatttgacggtgctctttttcatgtagacaaagaaagaattacaaaaacagaagcgaagaagctcataactcagtttcttcaaaaggaggttaaatagatgaacggcggaacatttacaccaggcaaggaaaaagagcgtgcgggtatctactttaattttaaaacgactgccgaggatcgtgtgtctgtcggtgaaaggggaaccgtggcgctgccgatcgcttctagttggggagagttgaaaaaattcatttctatctcttccattgaggatttgaataagaagatcggattaaacattgataatccttcgctccttctgctgcgtgaagcaatgaagaaggcaaaaacagtcttgctttatcggttgactgagggtcttcgtgcttctgcagaaattagcgaaggcgttaaggccaccgctctttatggcgggactaaagggaatgacatcattatccggatcaccgagaatgtcattaattcaaaaaaggttgatgtcattacgtatctcgatgagtcagaagttgataagcagaccgtagcggctgcggaggaattgaaggcaaacagctatgtatcctttactggaaaaggagatttgaccgtatccatcccgcttaccggtacatctcctgctgatgcaagcggagacttaccggcatccgccggcacccgtctttccggcggcacagataagatcccgacgaacgccgactatatggatttcttagatgcggctgaaactgaatacttcgacaccattgctctgccagtagaagacaatgaacagcttaaagccacgttcgtggcattcgtgaagcggttaagagataaccaaggtcagaagattcaaggcgtcctttcgaattataaaggggatcatgaaggcattatcaatgtgacaggtggggtcctgctggaagacggtactgagattacgcctgaaaaagctactgcctgggtggccggggccagcgcgggggctacctttaaccaatcccttacgtttgttgaatatgaaggggctgtggacgttttaaatcgcattgacaatgatgaaattgttgaacgactcgctaagggtgaatttttgttcactttcgatccccgcgataaggcggtggctgttgaaaaggatattaattccctgacaagcttaacggctgagaaaaacaaggtgttccagaagaacaaaattgttcgggtccttgatgcaattaataacgatctgacatcacagctgaaagcattaattaagtccagaaaagcgagcggcagcgatgtcccggcttcggatgacggcctgcagttcgtgaaaaccctgatcactcaatacatgggaatccttcaagatgggggcggcattacggggtttgactctgagtctgatatcgcgattgttctgaatgaagatcgagacggctttatcattgatttggccgtgcagcctgttgatgcagcagaaaaattctactttaacgtggaggtgaagtaagatggcttttaaagcgcagaatacgatatctggtaaagaggggcgcctctttttggatggtgaggaattggcttttattaaaacgtttgaagcgaacgtggagaaaaacaaatcagaagtcaatgtcatgggccgccgtatgaccggccataaaacaactggcgcgaatggaacgggaacagcgacattttataaagtcacatctcgcttcgtacagctcatgctcaattacgtgaaaaaaggtgaagatccttactttaccctgcaagccgtgcttgatgataaatcatctggccgcgggaccgagcgggttactctctatgatgtgaactttgactctgcgaagatcgccgggctggatgttgattccgaagcattggaagaggaagtgccgttcacctttgaagactttgatcttcctgaaaaattgaaggatactttttaaaaagacttaagtgtaaacaagagaatttttaagctaattcaagaaaacaggtgattttttaatgaatttaggagtcttagatttatactgatttcacttggggtatactattctaagggcttgtagtataattacgctaaacgtaatagcgtaatgaaataacgcattaattctaaatttgagttaaattgaattcctgttatcaaatgtatttctttcaaaaggaatgcataaaataaaaaaagacccggctgcaaccgggtcggtataaatgttggcccatcaagagggctggcttaacaacttcatgaaagatttacggatagacttaaccctttaacttttccacgagctcaagggtgggtctatttcttttttatataagtcaacagggcaattataaaagagccgaaagcaagcattagcattaatgcttgaaacgttgacatcatgagcatcaccccccttcatgagggagtgagccagaccgcccttgaggtgttgaaagccaattcatttatactaaaccatattgtaccataacactctcacaaccgagagtgtttttttattgcctgaagacaaccaaaacaaaaggagcaattaacatgagcgaaaaacaaaacgaaaaagtatatgatctttcattctttatgccaggacaaacaatcgaagcggaagaggtaaaagtgccgatttcaaagcggtttaaagacaaggcggggaacgtggttccgttcgttttcaaagcaattacgactgagcgcatcgatgagttggagaaagaaaacacaacatacaaaaatgtcaaaggccgcggccgtgtgaaagatctggacagccagcgcttctatgcacgcattgctgttgaaacgactgtttacccgaactttaaatcaaaagagctgcgcgaagcttacaagacagaagatccggtggaagtggcaaagcgcatcctttctgtcggcggggaatacgctaactggctgaacaaggcaatcgagatcaacggttttgaagatgatctggaagaccttgaagaagaagcaaaaaactaatacggggcggggataaagaggccgtgtatttctatttcgcaatgcacgagctgaaatattccccgtctgaattaagggagctttatgaagctccgcgtgaatataaggcgctgctgtacggcgccattgcttataaacttgatttgcttgaaaaagaagcgaaaaaatcataggtagctgttagaaaaagaagcagagaaaggaggaaaataaccatggcgaaactaacagccacatttgatctacacgataagatgaccaaaaagctccgcaaaatacaaggaaatgctgaaagacttcagagggctgctaatggcccccttgtttttgaagctgatgaccggacacaacggaccatacggaggatagatcgctcagccacccaattgacgcggcgcccccgctctcttgatgtccgtctcgatgatcaagcttcaggagggttaactcgcatcaggcggcagactgaggacatcacagaaggtgaacatgaggtcagggtatcggtagatgacagggcgaccccgcgcctacgtttaatcaggggaagcctgtctgatttacaacgatcggacgcaacgcctactgtctccgtcagagaccgcgcatccggggatttaaactctctccggcatcgcgtctcagatttagatggatctgaggcaacgcctactgtgtctattaaagacaaagcttccgctgctctcgatgctatcgagaagaggttggacggcttaaagactgtcacgattacattagcggcagcgggtggattatcaggcggcgcaattatgaactccggaaaaaatgcaatggctcaggacgcctatgtctcagcaacttcaaacgtgagcaaaaaagatgcagggcgaatgactgatgacattttctacaaaaacaaagccggtggatcccgggaggaagtaagctcagcattaaagggactctcgcaactgacgggggcatccggccgggcgctggcggaactcaccgagtcttcaagcaaaatcgctcaattgatgaatgctgaccaagctgaagtagaccgggcgttcagtgctatgtataacaacttgaaaatgactggtaaagagagcggggacaccatagcttacatttaccggaatgctggtgaccaggctgacgatttgctggacacaatgaatgaatacagttccactttcaaagacatgaagcttacgggcggtcaaatcgcaaacgccatgataaaagggaccaagggcggcgcccggaacttcgacaaccttgccgacagtatgcgtgaatttaacatccgtcgcacggagatgtcagataaccaagtcgccgcgtttgaacaattatttggcggcaaagaaacgcaaaaaatgttcaaaggcttcaaagacggttctatcagtggacaggaaagcctctttaaagtggctgatgcgctatccaaggtcaaagacaagaccaagcgtgctgccattgcaactgagcttatcgggacgcagtacgaggacttaaagcagccaatccttgatatggctgaggggatcggcacaagtgcgaaaacaaccggcgagctaaaccgcagctttactcagcttcggaataacaatccgatgacgcctgtaaatgatgctattagggattttgagagtatatcaaaggatatgggaacctcattgttaaccggtcttggccctgcttttgataagattagtgacttcctgaacagtaaagaaggcaaagaaaagctgaaagagattaagaacgacataaccgatcttggagaagctattggtgacaagctgaataaggctatcgaatttacggttaatcactgggatgaactgaaaacagggtttaaggttgtggtcccgcctctgatcggtttaatagcttatctgaagattctccgtccgatcctgaaaggaataggcacagccggcggcgatgctgcccgcgtcataaaaaaactgattccttcacgaacgggttcagcatccgcagatcccaatacgagaagcggtagaagaaacggaagggccggcagagcaagcccaacgagtatagcaaggagcggcagtctgacaggctgttgttgtgctggcggtttcggtggggaaggccggggaaaaggcagatcatctggccgacaaggaggcgctgcccgcaggaatcccgctcgtgggacaatcagcgtgcctgctgatcgcttaggaagagaacgggggcgtacaggggtgggctccgctgccggtcgggatggagtttcaaccacaagaacagaactccggtctgccggccaggcctcatccaaaatgggaaaaatccttaaaccgctttccggagttggaaagtttgcgaaaggaatcccggtacttggtacagcgttggcggcaacggggcttatcggtatgaataaagataatgccggtgaaaagctcggctctttcgggggcaacatggcaggcgcggctgccggtggggcaaccggcgcggcaataggctctgtcgttccggttgtgggaacagctgtcggtggtttagtcggcagtgctgttggcggcattgcgggatcagatgtaggttcgtcagtggggcagtggtttgataacggcggcatgtcaaagacatgggatagcatcaagactggcggtggagatgcctttgcctgggtatccgaaaaaggacaggacgccttagactggattactgacacctgggacgatctatcatcttggtttatggacaatgtctgggatccaattggtgattgggtcggtgatacccttgacgacataaaaaagaaatttgaagacggaaagaaatgggttactgatacttggaatacagtgtcaaattggtttgataagaatgtgtggacgcccatctacaatacggctgtcccgattatcaatttcgtagtcggcatttttgcttttgcgtgggatggcattaagaagatatggtctatcgtctcaacttggtttatggataatgtttggaatccagtaagtgatgcagtgacaacggtagcgaagtggatctggacaaagatcactgatgcgtggaagtggatttctgatacttggtctactgtgtcatcctggtttatggataacgtctggaatccaataagtgacgctgttgcgactgtggccggttggatacaagcgcatattgattatgcgcggatctggattcaattaaaatggcttcaagtggcgacatggttctatgacaacgtctggaacccaatcagtacagcagttactgacgtagcaaactggatttggacgaagcttaatgatgcgtggacttttatttcggacttatggtcaactgtgtcaacttggttcatggacaatgtctggaatccagtaagtgatgcggtgacaacggcagcaaagtggatctggacgaagcttaacgatgcgtggaattggatctccgatacatggaatacggtttccacttggttcactgaaaatgtctggaaccccattgtcacaaaagtggaaaatgctaaaaaatcaatcacgaaaaagtttgaggatgccaaaaacgcagttaccggcgcttggggaggaattgaggcttggttcaaaacaaatgtcggtgatcccctggggaaagtggccgacggaattaaaaagaagtttgagaaaacgttttggtgggtcattaaacttaaagagttagccgacgccggtggggagtttatcggttctattatacatcgtggtgaacaagtcactggactgcaccaaaaggggaaaacttcaacaaacaacaattcggcaggaacaggaattggcttagctcgtacgcaacaacagcctgcaaatagtgtttttccgccaaaacaaaaaagcgtactgcaaaagaatgccacaggcggcttcatcacaaagcctactatttcatggatcggtgaagccggtaaggagtttgttatccccgtcgataataatcgtggtcgcggtaagatgcttctttcacaggcggcttctaagctcggcatgagtgttgtggacgatatggctgcagcttcaagcggcggtggcgaatcttctgtttctccattatccagtggtgcggcagtttctgcttctgtctctccaacagtagacacgtccagtctgaatgaccaggcagctacatttggtcaacagttctcacaaggctttgatcaaggtataagcgacaatgttgtgtctatggatgcttggaaacagaaaaacgttggtcagcctatgaacaacttgatttcctactcgccgaattatgggaaacaggttgtcaatgggtttgccagtggtcagaacagcactgcgacaggtacggatggatttctgcaaaccaaagtcaaaacccctttccaaaatactgttaacaaatcagggtcatggggaagcgggacggtgaagggattcgcttccggtcagaacagtacggatcccggcactgcccagtatgtcagctctcgtatagaaaagccttttctccgttctaaagagtcctccaacggatgggggagcggaatgatcggcaactttattactgggatggcatccaagggcagcgaagtatctgaagccgcgaaggaacttgctaaaaaagtagaaaaagcattccgtgaggagcttgatatccattcgccttcccgtgtcatgatgagtcttggccgctttgcatcagtaggggttgttaaaggtctcggctctgtcgatgtgaaaaagtttgccgaaaaacaagcgggttcacttgcggctgcctattccggaatgggggcagtcagcggcaacgttaaggaatggctaatgtttgcaatgatcgcaactaaaactccattcagctggcttccgggcttgatgacaattgcacagaatgaatcaggcggcaaccctaattccattaacttatgggatagcaatgccaaagccggccacccgtcacaagggttaatgcagacgatcccaagcacctttgaagctcataaggcgccaggaatgaatgatatcagcaacccaattcacaacgctgctgccgctatcggctatattaaaagcagatacggatcgataaacaatgtgcccgggattaagagcctggcgcgcggcggcccatacgtcggttatgccaatggtggtttgatcactaaggagcagatcgcccgtgtcggtgaagggaataaacgggagtggatcattcctgaagagcggggcatccgcggccgttatttgcttggtcgtgccgctcaagcgcttggaatggaggtaactgatcctgcgcagacgggaacaactgaactctcttccgggaaagtatctgcggccacctcgggcggcacgcagactgcggttgccgcttccggcaacaaagaaattgtaattcaacttaacggcgatcaacatttttataacaatcaagacgctgatagcctcgtggccaaaatcaaacaagctctgatagatgaattagagaaggatatcaatatcggaacgaaaggagtcgtagcttttgactaagtctgtttatgagttttggatatcacaggggaaggacaggctgcggctgcccgtccttccggaacagatcgacatatctgatacgattcaaaatgactctgtaaaggttgcccgcttcggtgagattacctttatagataatccgggagcgaaagaaatttcgttctcttccttttttccaaagaagcacagtccgctctccgaatataaagggtttccttccccagaaaacgcaattgcaagaatagacaaatggttgaaatcgaaaaagcctgttcagtttttgattaccggaacaaaaataaacttaacctgcagtattgaggcattttcgcacagtgagggacaaaaggacataggggatcgagattttgaaattaagctgaaggaatacaggaccgcttcaccccggaagataaaacaaaagaagaaaacaaagaaaaaacggccgtcaaaatctgctccaaaaacatataccgtgaaaaaaggggatactctttgggatctggcgggcaaattctatgggagcagcatgcaatggcggaaaatatggaatgccaataaaacggcaatgattaaacgcagcagaagaaacatcaggcagccgggccactggatattccccggccaaaaattaaagattccgcaatagcaggtgatgacacatgattgagctttttgtcattaaagaaacagaatggcttgagctggtaacagagacagtctctcttgaaggacagcgatatcaagcgccgcgttcaatcacggccacgatcataacaaagcaaggaaatcactcttattacagcgtaactgaaggcgataccgttctattcaagtggaaaggtaaggaattattccgcggcattgtgttttcgcgcaatcctgatgatcaaaaattgacttttacggcctatgacatgcttcaatatctggtgaagaacaaagatgtttacgtcttctcaaatcagcgtgctgatcaaatagtaaaacggctggcccgagattttcaaatacccactgggtccatcgccaaaacagcatatactattaaatcattggtttttaaagacgataccagcctttatgacatgatattaaaggcattgaagcaaacaaaaaaacagaccggtcataattatcagttatatgcctcgaaggggaagctttgtctcagggcttggcctgacccgtcagaagtttgggtgttagagacaggcgtaaacatcacaggataccagtacagcacctcaataaatgaaacagcaacgaaggtcaaactccgccgtcagaaagacaataaaacgtatactgccactgcgcgcgatagttcaggaattaataaatacggggttctgcagtatgtggaaactgtctcggataatattaatcaggcgcagcttcagcagcgagcaaacgtactccaatcacagaaaaaaggtgtgaaaaaggaattaaagagtattcaagctattggtatccatgacttgcagagcgggcttccggtgtatatttctattccggaagtgggggtaaagaaaacatattggattgattctgacaagcacgaatttaaaggcagctcccacacgatgacaattgatgtggttgagaaaaacacaatcccggacggggcttcatcatgaggttaagtgaagcaattaaacatctggctatcggggctgttggttctgagtcgccggtggatatgctgccggctgaagtcgtttctgtttcccctgttgaaatcaagctcaatgaaaacgaaaaattgatcattccttctgacttaattattatccctaaacgcctgcgcgccgggggagaagatgagcttaaaactggtgagaatgtaatggttgtctccttaaaaggcggacaatcattttttattctcgacaaaatataggggggtgcgtgggttggccctttcaccagaaatagaatttgatgattttgaagatgacagcgaagcaatagagacatcgcgcacatatagaattgactttgaaaatgggcgaattactaacgagctgatcgcaggacttgaggcaattaaacaatttgtttatatggccctgcatacagagcggtattcctattctgttttcagtcatgacattggtaatgagcttcaagaggttctttctgataacgagacaacagacgcatataaaaaaatggagatcccgaggctgatcgaagaagctttaatttatgatgatcgaatttcttctgtcactgattttgagattgataaatcaggtgataggttcatagtttcttttatcgtagagacagacgagggcacgttggagatcgaggaggtgcttggcgaggatgtttgaagatcaaacgtttgaggagattatggatcgtatgctgtcccgtatctctgcggatattgatacaagagaagggagcgtcatttacaatgcgctcgcgcctgcggccgctgagcttgcaaagtcttatatttggcttgataccgttctggagctcgtgttttccgatacggctcagggcgaatttctggacaggcgggctgctgaagcggggattgaaagaacggcagccacaaaagctgtaagggcgggcgaattcacatcaggggtgaaaattcctgcgggttcccgcttctttgttgataatctctattttcaatatacagctgatggaacattagaatgtgaaacggccggtgaagctggtaatgcaaatatctccggacaaaatcttttgtcgctcgatacgatacccggtcttcaaaaggcgatagtgaaagagatcctgattcctggccgcgaagaggaagacgacaataatttgagggaacgctattttacccgcgtgcgccgagaagccgtaagtgctaataaagagcattataagcagtgggcggaagaagtggacggagtgggtaaagcgaaggtcttcccgctttggaagggagacggcactgtcaagattgtggtgacggatgctaagctggagccggcttcagatattctgataacaaaggtcggtgattatattgatccggagcccggacaaggagaaggccaggcgccgatcggtgcgtttgtaacagtagaaagtgcagaatggaaagagattgagatatccgcctctgtgctgcctgaaatcaatagctcgattgaccaagttaaagacgaaatagaagcgggagtcctgaatcttttcaaaaagatggcttttgaagataatgtgatccgactctctcaaattaacaacatcgtgtataattcgccatccgtgagcgattactctgatattaaaattaatggactggctgaaaatttggtcctggatgacattgaaatccctaagctcaggcaggtgaagatcgttgagcaaactcgatgagatgacggcttacctgccgcccttcttaacaaagttgaaagaaatgactcaaatccttcagacggaagcaccggaatttgagaagcaaaatgatggcatctttgatctgacagatcagctgtttgttacaacagctacctgggggctcgaacgctgggaaaagatattaaacgtgccgcgcgagtcgggtgatacgtatgagattcgccggctgcgcctgatttccaaaatgtccaatattcctccggcaacatatctggccattgagcgggcgcttaacaggttcttgaaaaatccgtctgcctgcgtccgtttgattcctggagagtatcactttaacgttgatattgatatagatgacctgcagcacatgactgagcttattgagacgttagagaacatgaagccggcacatttggcttacacactcaggccggcttttaatgagagtctgcaaataaaggatacagtcatattgaatcacaggagataccgtaaagtgagtgagcttcgggtaggttattccgtaactcttaataacaatgaggtgatcttgacatgatttcaaaagcatatagagagcgtactgctgccgatttaaaagatcgaatcagcaaagtgttgctgaatggaaaagagactgaaatcgtggagctttcgatcagtggcgcggtggttgcggtgctcacacatcgtgaagaggatattaagcacattgaatcagtgcagatcattgatgacttgggaaatgtgattactgaacgaaagactgatttaaatgtcagtgataacagaacgttagattttaggtttacttttgaggtggtataacaatggcttacgaagcaaaaacaaattggcttccagacgacccgattaacgaaggcgatgttaaccgctgggaaaaaggaataaaagacgcccatacggaccttgcatctcataaaaacgacatgaataacccgcataaaacgacaaagggacaagtcggcctcgggaacgtggacaacgtgcagcaggctccgaaacgagactttgatattcatgtgaatgatgctgaacttcatatcaataaagaagagcgggaaaactggaacaacaaagaaacccctgaaggatcaaaagaaaaagctaagcaggcattgactgaggctatcaattatgtgaattccaatttcaaaaacgagaacttaatttgcattcgtgatggagatgaaagagcgatcgtcgatgcaagaacaccaggcactgattaccctgaaggaataacctttatgggtatctatgagggcaatgacacaggctaccctcttggctatggcttaattaaaaatgaaaatttaaacaaatggcgctttgctcagtatttctatggtaatggcgatggaacaaagaggaagaatatcgggacatggattcgccattggtgggatagtacaggctggacaaaatgggaaaagatatcaggttttgctcacgcaagtgtgggagtatccgatgttcaatatttaaagcagattgatcacaccaagatagcttttaatcgaaaaataaaagacagtcatgatgcttttgatattaaaaataatagatttgtcgcgccgaatgatggaatgtacttagtgaatgttgggctttatatgatcaactacgctatgtatatcaactttcatctgaaggtgtatctaaacggaaaagagtataaaacccttgaccactatagaggatattttgataacggcaaagaaatgaatttagggctaaacggaacagccgctatcccgatgaacaagggtgattatgtggaaatcttctgctactgtaattatggcggagatgaaaccgtaaagagaggcattactgataagaatgatgtttacaacttctttgatattcaagaagttggaggattaaattatcccaatgtgtaaggaggtaaaaaatgaatataggtgaagcaatcctttataaatatcccgatgccgatccgactaaagattttatcattcagaataatggcgatggcaccccctcttacattgcacgatggaatatccgggcccctatccctacagaagcggatttgcaagcttggtgggacgaattaaagcaaaatccgccatttgaaccgcctgatcaaattcaattactggcacagaagctttcggaagaaaaactggcccgtaaacagcttgaagaattaaatcaaacacttggacggcagctgtcagaactaaagctcgccgtaatgtcatgggaagagagggatgaatcaaaatgaattattggatattggcactatattataaatgggccactccggagatggtgaaaaaggcaatgtattacgacgattgttctgcagctgatttacagcagggcgttgaaaagaagctcgttaccccgcaacagtatatagagatcactggtaaagccttataggcttttttattttgccttgaagggggtgagacgatgtcataagtctgaaaaagtccgctcaaataaataaaaaacttttatgaaggaggacaattatgtcatctttaggattcacatttccaacggatgccgcgggaaagccgggcgcagtaaaaccatttagagaaggaaaaagcgattttgttgagccagttgcagatatttcaggaacagcagagcttctgactaatgcaacattaaaggctacagattcttatagccaatatggccaggatagattgggatcgatcttaatttctaaaatcaaaggcgctgcatattcggatcgcgaagggaccctatttattgagcaaagcaacgataatgtttcatggtccaccatcacatcattagaagtgaaagcaaatactctatcagagactgattgggtcgatttatcacagagatactaccgcttcagatatgcgaatggtaacctgcagcaatcagaatttttactgtatcagtcgctcggggcaggccagggagatgtgaagattcgggattcagtctcaattaaatctgataaaccgctcccgcttgaatttacatcaagcaatgtaaccaaagacggccgcttaaaggtagaaacccaaggaatcgcgattaatccggctgattttgaaagtgtacaggctaaaacagccgatatcgtttttcatgacaaagtggagaccccaggcgaagggaatattttgaaagtcggttcctttaaaacattattgattgaagtctatggcacggctgatacaagtgaattgaagttctgggggaaatctctttcaggaacaaaacgcccgctgcgcggccaaaaagtagacgacggcaccctggctataagcacagtcggtaagtcagaagcttggacttttgatattacaggattcaaagagatcgtgatggagattaccgctttaaataatgggaacttttccgtaaaagggacagccgtctcataaaatagcggctgtcctttttaattgcctcatacaggaggtgaaaacgatgtaataaaaggggggcgtactaatgtcagaagtgacggaggtaccagatgtgcatgtattacaaaaagagataatggaaatgaagacaggtcagaaagcaatcgaacagcgcgtaaatgttcttgaacgcgtttccgataggcaagaccagcagatcatgacattaaacgaaaaactcaacaagatcgaagagaacacaacttggatcaagcgcacaatcactggcgctatcattacagcggtatgcactggcattattggcggcgcaatcgctattttttatactgttttgcagaaataaggaggaaaatacatgaaaagatttgaaaaaggcacggtcgtccggacggtgcttcttttaattgcgcttattaaccaaacaatgttgatgtttggcaaatcacctttggatatcacagatgcacaagtgaatcagcttgctgatgcgctgtacactgccggctctgtaatatttactatcagcactacgcttgtagcatggttcaaaaacaattatgtgactgaaaaaggccataagcaaagagccgttttaaaacagcacgatttgaccaagtaagagctgccgttcggcggcctttttatatttcaaaacagaataggagagatttttcatgacaattgcagtcaaaaaaagaatagtagaatctgagaaatatgctctgaaatgtccgaatccgatgacgccggagtacatcaccattcataatacggcaaacgatgcatcagccgccaatgaaatcagttatatgactggtaaccctgaatcgacaagctatcattttgctgtcgatgatatagaagtgattcagggaattccgctgaaccggaacgcatggcactctggcgacggcacaaacggaaccgggaaccgtaagtctattgcggtagaaatctgctacagcaagtcaggtggcgcgcggtaccgggcagcagaggcgctggctatcaagtttgtggcgcaacttctcaaagagcgcggatggggcgttgacaaaatcagaaaacatcaggactggaacggaaaatactgcccgcatcgcattttgtctgaggggcgttgggaacaagtgaaagcggccattgctgcagaattagaacgtcttgggggtaaaaaagcacccaaaccaccaaagacagaaaccaagacaggcggggcgacgtacaccgtcaagaaaggcgatgctctttctgtcattgcacagaaaaatggtgtgagcatggccaccctgcaaaggttgaacggtatcaagaatccgaattttatcaaagtcggccaagtattaaagctgacggattcggccagtaccccaacaaaaggtaaaaaatcatcttacgcgctgccgtcaggtgtttttaaagtgacatgccccttaactaagggacccgccgtgaaacagattcagacagcactggcggctctctattactatccggacaaaggggcgaagaataacggaatagatggtgcatacgggccgaaaacagcaaatgcagtcaaacggttccagtccatg

SEQ ID NO: 139 - DNA, 19376 bp, Bacillus velezensis FL50S
cgtccgtcttctgctgcgggaacggtgtgtccgttttctgctgcgggaacggcgcgaacattttttggaaaccggttcttggtataaatactcccctaaaccttctctttccgcaacggcaactccatgttcaatttctttaacagaaatagcgttcaattctgttcacctccctttttctttccaacataacgtatgaaatgtacccctcacgtgtataagcttctctctcatatgagcgagaaatagtcatttatacaacaaaaagacccgtggaaacgggccttttgcaggcattttgccgggaacaaacgcaaacttaagatcgattatttcttcctctcgctctccggctcggggtgaatcattacctgtgcttgtttgaattcattcgtaatatctctttcaatgcggtcacacaggtcgtgcacgtctttaatcgccacgtgagaggctacgaccaggtgaaaatcaatatactcctgggggccggagcgtcttgtacgaaaatcgtgaatttcaataaattcctgttgaaatgtttcgataatctttaaaattgttttttcttcctcttccgacaaacgggtatcaatcagcggcgggaatgcttctttcattaacttaaacgcttcatatatgatatacaccgccagcaccatacctataatgggatcaagtatgtaccactccgttaaggtaacgaccaaaaggcttgccgctacgcctaatgatgtgtacacgtcagtcagtaaatgcagggcattcgatttcattgccacggaattaaccttttcggcttctctttttacgaacttcgaaacgatcaaattaatgagagcccccgcaagcatcacagcgattcccaatacgggcagatgaaccggagccgggttgaccagtttttgaacgcattcatatatcatccaaatccctgccgcaaaaatcagcatcgtctcgatggtccccgacagattctcgacttttccatgaccgtacggatgccctgtatcagccggcttttttgaaatcctgacggagataaaggcgatgaaggcggcgatcaaatctaaaaaagaatgaatggcttccgaaagtatcgcgacagatccggttatgatccccaccactattttgagcatgacgaccagggaattgcttataaccgataaaaaagcgattttagaggtgttttccaccgtgatcctcctctttttgacttcttgtatttatcgtatcaaacggcattcgtgtgggtctacggcaacgtttttcacaaaagccatacatgtaactcactataaactaagttggaaagcgacaaaacaggcgaacctttctttcagcactcaagtcccattgacaagatataaccgcttacattatagtagtttcatgaataaccactacggaggatgtttatggatgatgttctgaaagaattacagaagtttggattttctcaatatgaatgtaaagcatatatcggcttgttgaaacactcgcctgttaccggatatgaaatcagcaaaaggtcaggcgtcccccgctcaatgatctatgaggtattggggaaattagttgataaaggcgctgtccatattgtgccgtctgatccggttacatatgccccgctggccggaaaggaattaatcgaccggctccggcacgatttcgagagctcattcggctaccttgaggaaaagttattggcgctggaaagcgagcaggagatgaatgtcatccgccgcatcagcacgaatgatcatgtcatcaatgagatgaaggaaatgattgaaaaagccgaggaagagttgtggctgtctgtctgggaacagcagattccctttattcaagaagccgctaataaacgcgccgccgaacaattgcccgtcttttcgattgtgttcggccctccggaagtgaagctcggaaatacgacaaatcataatatgtctcctgaagtggcggagaaacggatgggcggaagattaacgatagctgcccgagataataaagaagtcttaatcgccaatttttctccgcagacgaatgcctgggccattaaatcagaagaccccgctctcgttctcgtggccatggaatatatgaggcacgatctgatgttcgcggagcttgtgaaagaagtcggggctgaaaaagttgaaggcctgatgaaacaaaaccattcgttatttcatgtcgtcaccggaaatcggttcatataaatgtgaaccgtattttctttgattttttcattagtcgttatcattataatctctatgaaaggagtataaaaaatgattaacacagaagtgcaaaaaaccgccgtttcccgggaaatgaacgatacgtttttacagggggtgcgggattgtgtgcctacgctgctgggctatatgagcatcggttttgctttcggcatcgtcggggttgcctctcatctaagcattcttgaaatctgtttgttatccttgtgtgtctatgccggcgccgcccaatttattatttgctcgctccttgtttccgggagtccgatttccgccattattttaacgacgtttatcgtcaatctgcgtcaccttctgctgagcctgaccatcgcgccgtatttcacgaaatactctctggcgaaaaatatcggcttcggggctctgcttactgacgaatctttcggagtagcggtgaacaaagcggctcagaacggcaggttatacgataagtggatgaacggcctcaatataaccgcttacatgtgctgggttatttcctgcgtgatgggcgggcttctcggacaatggatatctgatccttacgctctcggcctggactttgctttgcctgctatgtttgcggcgctgcttgtgctgcaattgcagtcgtccgcttcggaaaagctgaagcacagcctctccttaattctctatatgatcatttttatggtcttgttatcgtatttcgtcccgtcacacatcgcggtcatcgtctcaaccgtaattgtggcaacgatcggggtggtgacggacaaatgagcatcagcacacaaatgatctggattatactcggctgcatgattgttacacttgtgccgcgcattgttccgtttatatttgtccggaacattcagatgcctgaattggctttaaaatggctctcctttattccgctttgcattttgacggctctggtaacggaaagcatgattgtgaaaacaaacagcgctttgacctttgattggaaagcaatgatcgttctcatcccgacattgctttgcgcgatgctgacaaaaagcttatccatcacggtcatcacgggagtcgtgctgatggccgccgtcaggctgatatggtgacaatcaaaagcctccattccatagaatggaggctttacctttatgatgtcggattttcttcttccgtctctgattcctcggcttcggcgtttatgctttgctgctgttcccaatgatcccgctgcaatctttctttggcgatggtaaacatgaaattcacggcgcagcaccccttccctgttttgcttatactatgtactgtactcatttccccgtgcagtattcacaaaacataaaaaagcagcctgccgcatggagcggccggactgctttttattttcagtacgtgatcaggaagtattttttctttccgcggcgcagtacggtaaattgatcttcaatgcggtcttccgcagtcagaagatgcccgatgtccgtccggcgctcgccgttaatgtaaacagctccgttttgaatgtcttcgcgggcctgccgttttgaaggcgacagtttagattccactagcacgtctactaaagacagttcttgagagcggtctttttcaaacgaaggtacatctttaaatcctaccttgacgtcttgagcggaaagctctttaatattgccgctgaacagcgcctgggagatatgaacggcctgctcaagcgcttcacggccgtgtacaagaaccgtcacctcttcagcgagacgtttctgcgcttctcttttctcaggagctgtctccgttttttcagcataagcttcaatttcctcttttgacaagaaagtaaagtattttaagtatttgacgacgtcgcggtcatcagtattgatccagaactggtagaattcgtacggcgatgttttttctttatcaagccaaatggcgccgccttccgttttgccgaatttcgtgccgtcagcttttgtgacgagcggaatggtaagaccgaaagctttcgccccttcttcttctgattttctgatcagttcaagaccggccgtgatgttgccccactggtcactgcctccgatttggagtttgcagttcttttctctgtacagattcagaaaatcgtaggattgcaggatcatgtagctgaattccgtgtaagaaattccggtttcaattcttgagcttacagtatctttcgcaagcatgtagttaattccgaagttctttccgacgtcacggagaaattcaatgatgctcagctttccgatccaatcaaagttgttcgctatgacagcggggttttctcctgcctcgaaatctaaaaatcgggaaagctgatttttaattttttgcgaccattcgacaacgatatcctgagtatttaacgtacgctccgcttttttgccgctcggatcgccgatcagtcccgtcgcgccgcctacaagcgcaatcggatggtggcctgcaagctggaaacggcgcagtgtcaatatcggcagaaggtgtccgatgtgcaggctgtcagccgtcgggtcaaaccctgagtataaacggattttttcttcgctcagctgtttattcagtccttcttcatccgtcatttgctggattaagccgcggaatgataaatcctctaataagttagtcattttgtctgctcctttgtttatgaaaataaaaaacgccccttcgtttaaaacgaagggacgatataatcgcggtaccaccctactaataaaaacataaaaaagcttttatcactctttttgataacggaccgtgtccgttctttcactactgaaagccttggaatagctttgttcgcaaaagcggttcatgagtgtattcggcatatcttatgtgctgattttcaccggccatcagctctctggaacaatcagatatcctacttgtctcaatcaaaaccttttcgtatgaagcttactcatttttaacataaataagatacgatgtcaacgccgtctttaatcttccattgtggacaggtcgcctgccggcaggttcagctcccatgccttcagcacacgtctcatgatttttccgctccgtgttttcggaagtttatctttgaattcaatttcccgcggtgcggcatgcgcggcaagcccctgttttacaaagaggcgaatgtcctccttcagctgatcggatggctcatgcccttctctgagcgcgataaacgctttaataatttctccccggacagggtccggctttccgatgacgccggcttcggcaatcgccggatgttcaacaagtttgctttcgacttcaaacgggccgacgcgctcgccggatgtcatgatgacatcatcgactctgccttggaaccagaaataaccgtcttcatccatataagcagaatctccggaaacataccagccgcccggcataaaataagaatcatatttctctttgttgttccaaatggaatccatcatcgacggccagccctttttaatggcgagatttcccattcggtacggcggaagctcatttccctgattgtcaacgatcgccgcttccactcccggaatcggtttccccattgagcccggcttgatctccatgcaaggataattgcagatgagctgtccgcccgtttctgtcatccaccacgtgtcgtggatgcgcttgccgaatactttatgtccccacttgatgacctcggggttcaaaggttctccgacactcaggacgtgacgaagtgaagtaaggtcaaatttggatgccatttcatctccggcgcccataagcattctgaaagccgtcggagcgctgtaccagacgctgacaccaagcttctcaatcgtgccgtaccagttttccggactgaatctgccgccgacgatcacattcgccgctccgttcagccacggcgcaaatatcccgtacaccgtcccggtcacccagcccgggtccgcagtgcaccaataaatatcgtcttctttaagatcaagcacccacttgccggtctggtattgctgaatcatggcttcatgaacgtggagcacaccttttggcgttccggtagatcctgatgtgtagtgaagcaggtagccgtctcttctgtccatccattcaatatcaagtctcgtgctttctccctcagccgctttatcataatgaatgattttatctcccgcttctttgctgccgccgacaatgaaaatatgctcgaggtcgggcaggctgtccgccggaatccgttcggccagttcaggtgtcgtcacgacaacctttgcctggctgttcaacaggcggtctttgacggcgccttccataaacgcttcaaataaagggccggcgatcgcaccgattttaattgcgccgagcatgataaagtacagctccggcgaacgcggcatgaaaataaaaacgcggtcccctttttccacgtttccataccgtcccagtacatttcccgcccggttcgattcctccatcatttctttaaatgtgtatttttcattccgatttgcgtccttgtaatacagcgctactttgttttttcgaaatgattcggcatgacggtcaattgcttcgtacgccgcattcagcttccccgtctgatgccaggaaaactccgcttcgacctctttccaatcgaagctgcggtacgtttcctcataatttcgcagatgataattccccttttccgccggcaacgctttcaaattcatgcaacatccccctttgcttatctatagactaattatagtagatgttcacagttttctcaatttttaaaatataaattacaacactattgaaaacgctttatattttgttatgcttaagagagatgtgtttttattaagaaccgacaggcggtgaatcagtgaaacatcataaaacgtaccattcttcatcaattcagacagcagccggccctctattggtagaagggcccgttcctccaaaggacctagcacagtatgagtttcatgaaggcctgacagcctttcgccttcctcatgaacagcacaaagcgttaatcgagatcgccgggcttcctgaaggtcggatcattatcgccagggacggacagacgattatcggctatgtgacgtatttatatcctgatccgcttgaacggtggtctgacggcaatatggaagatctccttgagctcggggcgatcgaggtcgctcccggctacaggggctgttctgtcggaaaaacgttgctgacagtcagcatgatggatgaacagatggaacgctacatcatcatgacgacggaatattactggcattgggatttaaaaggaatgaaaaaagatgtgtgggaatacagaaagatcatggaaaagatgatgaatgccgggggtcttgtctggtttgcaacggatgaaccggaaatcagctctcatccggccaattgtctgatggcccgcatcggcaggcacgtcagtcaggagtcaattgaacagttcgacaggcttcgtttttatcagcggtttatgtattgactgacatacaaaggggataaaaagatgattgcagaacaaatcatgaaacgggacgtcatcaccgtctcaaaacacgactccattgaaacagccgtccgtaaaatgaaggtatatcatatccgccatctccctgtcatcgacgacgagctgcacgtcaccggtattgtcacagacagagacattaaacaggccggccccggcagcttcgaacaaaaggaacgcggcgcgtttctgacaaacaaagtggagaccattatgaagcggaatgtcatctgcgcccatccgcttgactttgtggaagaaatatccgcttccttttatgagcacggcatcggctgtctgccgattacggtaaatcataagctgacgggcattttaacgaaaaccgacgtgctccggactttcgtcagcctgacaggcgcggcccagccgggatcacaggtggaaatcctggtgacggatatgacaaaaagccttgctgatctcagctgcatgtgccgtgatcttcagctgcaaatcctgagtgtgctcgtctatccccatgattccgccgggtcgaacattctcgtcttccgggtaaagacgatgaatccgctcccttttatccgtgccgttcatgaagccggatacaatgtcttatggccgaaacatttgagggatcagccatgagagacagcgtttttgtttactcgccttcttatcagacgtatcaatttcatcaggatcatccgttcaatcagcagcgcgtgcttttaacatacgatctgcttcaggcggcggacgcgtttgacgatggagacatcgtcaaaccgcgcacggccactaaagaagagctgggtctcgttcatacggaggattatatacaggcggtggaacttgcgggcgcgggccggctccctgccgcagaaggagaaagctacggtctcggaacggaagacacccccgtttttgccggcatgcatgaagctgcgtcgcttctggtgggcggcaccttaacagcggcagattatgttatgacgggacaagccaggcatgcctgcaatttaggaggaggccttcaccacggcttccgcggcagggcgtcaggcttttgtatctataatgacagcgccgtggccatccaatacatccagaagaactacggggcaaaagtgttatacattgatacagacgcccaccacggcgacggcgttcaatttacgttttacgacaggtctgatgtctgcactgtttcttttcacgagaccgggcgttatttatttcccgggacggggcaggtactggaaaaaggaagcgggcaaggctacggctattcttttaacattccgctggacgctttcacagaggacgattcctttctccacgcttacaaaacggccgcctctgaaattgcggctttttttaagccggatgtgattcttacccaaaacggtgcggacgcccattattacgacccattgacacacctgtccaatacaatctccatttatcaggagatcccgcggctcgctcattcattggcccatcaatattgcagcggcagatggatcgcggtcggcggcggcggatacgatatttggagagtcgtcccgagagcatggagccgcatttggcttgagatgaaagggattgatcccggggagcgcataccgcagaaatggattgataaatggcagaagcattccccctgcacgctgcccgctttttggagtgatcctgaacaattatatcctccgattccacgcaaagaagaaatttcagaaaaaaatgcccaaaccgtggaaaaagcactttttgccatccggtctgagcagcggtataaaacaaaataaaaaacgaccttatgaggaggtcgtttttttgatcacgatttctacacggcggttttctttcatatgtccgggacttttgttgtccttcacaggtttcgtatccgcatacccggcagagataaaccgtttggcggaaaagtcttcattcgcggtaaaatactggatcacactcgccgctcttgcagacgacagctcccagttcgacgggaattgataggtggaaatccggcggctgtccgtatggccttctacctgtatgtcattcggaattgtttttaaaagcaccgcgatctgatgcagaaccggctcggcgtttttcagcacatccgcttttcccgtctgaaacagaacggcctcctgcagcacaagaaccactccgcgctcatcgcgcttcgccgtcaatttggaactcaaatgatgcgcttttatgtatgtcttcacgttttgtaacagcaaatcctgttctttattttcgtttgctttgtctgatgacgccggttcacctccgctgccgtttgtatgaatcgatgaaacggcagattgaaatttttccgcgtctatttgcgacatcgaaaaaagcaagataaagaacacgagaatgagcgtgatcaagtcagcgaacgtcaccatccatctcggtgaaccgccggaatgttccggtttgtttcttctttcaaaacgctcttttctaagcttcatggacagcgccctttttcttgttcgcaggctgtcctttacgccagtcttctcttgagctgaagacgacgagctgactttcgaggttgcggggatttttgcccgattggatgccgacaaccccttcgatcatgacctgtttgatgaaaatttcactttccgttttttcttcaagctttgccgcgattgggataaacaccaaattggcaagcagcgctccgtacagcgtcgtcaatagcgcaacggccatgttcggtccgagggtatgcgggtcatttaagtttttgagcatgagaacgagtccgacgagcgtcccgatcattccccaggcgggtgcgaaatcaccagctttttcaaaaacgcgtcttccttttctgtgtctttcttccattgcggcgatctcagaatccatcaccagccggatcgtttcctcgtcccagccgtcaatcgcaagcaaaagccctttttttaaaaacggatccttgatctcccgcgcctggtcatccagagacagcagcccctgcctgcgcgcctgctccgaaaggctgacaaatactctgacaagctctttcacattgtcatcctgacgggagaatacctgtttcagaacagaaggggttttctttaaatccctcggcggaaagctgataaagaccgccgcggcaaggccgcctgtgacgattaaaaaagaagtcagatccaaaaatgaactgattcccgccagtcccgtccctgacagaataccgattgcgacaataatacagcctaacataaagccaacgggcgtcagataatcaaaacgtttcatatcttctccttactcaagtaaaaaagcaagattccacccctcagagtgaagcttgcttttccgtttttttatgacttggttgattgtcttaattcgatgcggtgaggcaattcgacgatatgctcttcaaccggctctttgttcatcagttttgtcaaaagtctcatcgccacggcgccgatatcgtacgtaggctgcacgactgttgaaagctgagggcggaccatcaggctcaatctcgtattgtcaaaaccgataatatcaagatcatcaggtatcgaaagaccttgatcttgggccgcatggataatgccgagggccatttcatccgtcgcagaaagaatcgccgtcggtttccggtcaaggcccatcaagctttgaagcgcctccataccggaatcataagtgtaatcgccttccgctacgaattgctcgttaaacggaatcgccgcttcttcaagcgcccgtttgtacccttgcagttttttcgaacggttgatcggctcttgcatcggtccggagacgaatgcaatatcgcgatgccctttatcaatgaaaagcttaacggcatcataaatcgcctgttcataatcaatggcgacagaaggcgtctcgccctgttcttccactgatgcagccaagacgatcggcacaggagagcgcttaaattcttcgacatgctcgtccgtaatgttgccgcccataaatacgataccgtccacttgtttgccgagcatcgtatttaacagatgcagttctttctcaagattttgatccgagttgcttaagataatattatatttgtacatcgtcgcgatatcttcaattccacgcgcaagttccgagtagaaaatgcttgagatatcagggatgatgacgccgaccgttgtcgtttttttgcttgcaagccctcttgccaccgcgttcgggcggtagccgagccggtcaatggcttccaatactttttttctggtcgtcggttttacattcgggttgccgttcacgacgcgggaaacagtcgccatactgacatttgcttctctggccacatcgtatatcgtaatgttgctcactgaaaccactccttttactggatacacttatccttatctatagcataaacactttatgtaaagaaatgtcgtacgatttcgcattctgtcgtttatgattgtaagcgtaagtcagtagtgtacattatttttcattattcatcaaatttaaatatctctcatgaaattatacacgtttttcccaatgatgaaaacgttcactttcattttataattaaataaaatgaagatacgaaaaaaaagccgcgcgaggcggcctttaaagagcggaacgttgtattatgcttttactttcagcatcggctttaattcgttcagccatttctcgaattcagggatatccatctgctgcgcagagtctgaaagggcaacggaaggatcagggtgtacttcggccatcacgccgtcagcgccgatcgcaagcgccgcttttgctgtcggaagcaggagatcgcggcggcctgttgagtgtgtgacgtcaacaaacaccggcaagtgagtttcctgtttcaaaatcggcacggcagaaatgtcgagtgtgtttctcgttgccgtttcgtacgttctgattccgcgctcacaaagaatgatttggtcgtttccttgtgacatgatgtattcagctgcattgatgaactctgaaattgtcgcggcaagaccgcgttttaacaataccggctttttaacggaaccggcggctttcagcaattcaaagttttgcatgttccgcgcgccgatctgaatgacgtcaatgtaatcaatcgcttgctcaatgtgggcgggcgttacgatttcactgatcaccgcgaggtcatattcatcagcgacgcgtttaagaatttgcaggccttctacgccgagaccttggaaatcatacggacttgtgcggggtttaaacgcgcccccgcgcaggattttaatgccttgttttttcgctgcggccgcgacttcggcaacctgctcatagctttctacggcacaaggtccgacgatgaatctctgatcgccgtcaccgattctttcacctttaatgtcaacgatcgtatcttctgcttttttcttccgggagacgagcaacgctttgctgtgatcctcttcttgaagttcaagtccggctttgaaaatttctttgaaaatatgctggatcgttgagttttcaaatgggccgtcattgctttcaataatgcggttaagcattgtacgctctctgacagggtcaaatcggttgacaccctgtgcttcctttgctttaccgatttcttttacaacggctccgcgttcattgattaatttaaggatttctaagtttagtgcgtctgcttgctgtcttagactctctaattccttgttgctcatctttttcatcccttctatgctatgttttattttaatggttaacatgcatcttactacagttatgcgaaaataggaatatgaaataataaattttttcacattcgactttatcaccaaaacgcttttaagcttttatgcgttgaagcagtatatattgatatcctacatgatccggctgaaatgatcaatagtttttttcaaaaaaaaaaaccgccggtatcaaccggcggccagcaattatgaaaggtgctgctctattgcgttttttgtgatttgtgaatgagacgcgtgccatttcacttcgccgtttgtaataacgaatacttgcgggctttcatgtttcactccgtatgcctcggcgatatagtttgaaagcggccggctgtcctgcacatgcaggtaataagaaggtacttctgaatgctccgatgcaaaggcgtcaaactcctgaaacgcggcttggctgatcgggcaggttgtgctgtgttttaaaaacacgagcgtgttttctttctcagcggcatttttaaactcttcttcagacgatatcagctgttttgtcatgtcggttatctctccttattgaagatcagcgatttgcctgaccggctttttccccggcgtcttccgcttcggccttgatgctttgggccgtgtcctgcatttcgcttctcgtctcttcggctttctcggttagtgtgctcttagaacggtcttttaaatccttcactttattcataatctgacctgactgatcagctaccagctgggtgatattagatgttttgtccttggcgatgctgacatattgagagcctttttctttcgcgtcggccgtcattctgtccgtcttatcctttaacgcagaagcctgactgccgagatcgtcgcgcagctccttacctgatttaggcgccagaaacaacgccgttgtcgcgccgataattcccccgatcagcgttccgattaaaaaatccttactattgattccatctttgctcattatgattcctccttagtggatttttcttatgattaaagcgatgtttttttcttttgcttccacttgtcccatatttccatagcggcctggctccaggtgacaacctgactgatcttatcctgattctctcttacagaggccgtaacagaacctgctgcctgctttatggatgtattaaactgctggacggaagttcccacttcctggacagcatggacaaccgtatttaatttctctgatttttcctgaatgtcttccgcgagacggtttgtcttatgtaacagctcggctgtctctgcggtaatgcctttcatctgcccttcaaggccgtctaaagtcgaggctacgtttgttaaagtcatttgcacggactttaatgttttggacagatagatgacgaggatgagaaatgcaacggcaatgagtgcgacgcttaagtaaagaatgatgatcatctaatacctccttaatgcaggatatagtggtatatacccaattcttaaaatgataaacatatatgaaaggtctgtatgtatactatttctccgtttatcggtaaatccctttgcagcacgcgcaaaaaagcagtgagagccccactgctttttcgttacgctatgacgttttcataggccctcatatatttttgaatgtctccggcgcccatgaagatcagcactgcgccttcatgcgcttttaacacggaagtgtcattttcttcaatgagttctgcgttatcgattttttcctgaagatccgtgatcgtgagcttgccgacgttctcacgggcagagccgaaaatgtcgcacagatacacgcggtcggccgcgcttaagctttctgcgaattcatccaggaatgattgcgtccgtgtaaacgtatgcggctgaaataccgcgatgatttcacgttcgggatatttttggcgcgccgcctcaatcgtgactttgatttcagtcggatggtgggcgtagtcgtcgatcagtacctggcttccgatcactttttcattgaatctgcgtttgacgccgccgaatgattcaagtccgagcttaatcatgttcacgtctatctcttcatagtggcagagcgcaatgaccgctaaggaattgaggacattatgatggccgtatgccgggatgtagaacgtatcgtaaaacgtattgcggacaaagacgtcaaatgtcgtgccttccgtattttttacgatgtttctcgcttgaaaatcgttttcttctcccgtgccgtaataaacgacaggcacattggcgtgaattttcggcaggtactcgtcatcaccgcaggcaatgatgcctttgttgacttgaagcgccatgttttggaaagcatcaaacacatcgtcaatgttggcgaaataatcagggtggtcaaaatcaatattcgtcataatcgcataatcaggctgatagcttaagaaatgacggcggtactcgcaagcttcaaatacaaagtattcgctgctttcatttcctctgcccgttccgtccccgataagaaacgaagtcggcttcgcctgctgcatcacgtgtgccaagaggcccgttgtggacgtcttgccgtgtgcgcccgttaccgcgacacttgtgtattttttcatatattcagctaaaaatttatgatatctgatcacaggaatcccttcatcgagcgcctttgcaatttccggatgagaatcagggaatgcgtttccggcgattaccgttaagccgggtttgatgttatcggcgctgaacggatagatcgggatgtttcttttttcaagggcagcctgagtgaaaatctgcttctcgatatccgatccctgcacctgataccccgtatcatgcaggatttgagcaagcgggctcatacctgtcccttttattccaacaaaatgataaacagtcataatcgtacctccaacaaacgtctatctgttccccagtatatgacgctcatttcattttgcgaccgcagcgggcgaaaagcccgcacagcggcgcttccatttatttttacgttatcgtcagtatctgtaactttctttttgattaaacctgccgcatgatatttcagcgcgtgacagtgatgcagttttgatggtccatccactatcataccatgtttgtgagaaaaatgaacgatattcttattcttgagaaatgtcagcggccgtaatcagcacttcacgcggtttgctgcccttcgcttctgagatcatgccttcggcttccatcatgtcaatcagcctcgcggcgcggttataaccgattctgaaccttctttgaaggcttgaggtgctggcgctgttttgctccacgacgaattggcacgcctcaggaaacagttcgtcttcttccttaagggcggttccctgcctgatcagttcttcctgttcaaacaaataagaaggcggcagctgctttctgacatgagagacgacgcggtcaatctctctgtcggatacaaagttgccctgcaggcgcaccggttttccggtaccgttttcccagtacagcatgtcgccttttccgagcagcttttccgctcccgccatgtcgatgatcgttctggaatctacctggcttgagacggagaatgcaatcctcgtcggtatgttcgccttgatcattccggtaatgacatcgacagacggacgctgtgtcgcgacaagcagatgaatgccgcaggctctcgctttctgcgcgattctggcgatgctttcttccacatcgttcggcgcgaccatcattaaatcggcaagctcatcaatgaccactacgaggtaagggagcttttcgcctgtcttatgatcggccgttaattcattaaagcgtccgatatctctcacacccgaatgggcaaacagttcataccgccgttccatctcttccacaacccattttaacgcggcggtcgcggctttggcgtccgtgatgacggggctgaccaaatgcggaatttggttataaggcgcaagctcgaccattttcggatcaatcagaagcattttgacatcactcggatccgccttataaagcagactgaccaaaatggtattgatgcagacgctttttcccgatcctgtcgcacccgctatcaacccgtgcggcatctttttcaaatcaatgacgaccgggtttccggaaatatcgacaccgagcgcggctgtaagcggagacggattcgtcctgaaagcggcgcttctgatcatctgccttaaatcgacgactttgcttacgcggttcggaacttcaatgccgatcgtgtttttaccggggatcggcgcctcaatccgaatatccttggcagacaggctcagtttaatatcatctgctaagtttgtaattttgtttactttcactccgggctcaggatgcacttcaaaacgtgtgacggacgggccttgtgtgacatgaacgacttgggcgcgcacattaaagtttttcagtgtaacgtttaaaagctcgcgctgttcttcaatccacgattggtcgtcatgtctttgcgccggcggtacgtccagaagcgacagattcggaaagacatagctcgctccgccctctggcgtcttcgtctgcttgtgtttatcgcttttaagcatcatgacgttaaacggaacattgcgctctttcggctgctccgcttttctcacagtctgaggctgtccgtgatgctccgttttttcttcggcaggccgggatggggcatcggtcgtctcaatgcttacaggttcaggctcggggtctgaatgccgctctgcttcattgtactcaggctgagagtctgcttcctgtttcgcgtcgggttcagctgattcgggcttgtcttcagactgcggctgaatttcctcgtatccgggttctgtgtatgtatacaccggttcttctgcggtttcaaaaggcggtgctttttccggctcaggctcctgatgttccccctccggcgccgcttgttcctctgtgttttcagccgttcgggatgcttcagactcaggctctcttataggctgcgggcgggtttgttcatgctcttgttcttctgtaaagccggcagactccgcgctttcggtgtgctccagctcttcagcctgctgcggttctggtgctgcaaacacttgctcttttgcattctcagcctccgtgtgaagctcctcttttttaacggccggaatttcttccgtttcttgtttcgcaaacggttctggccggtcattcgtctgttttgttataccggatgttgtgaagacgggctctttttccgtttcctgaccggattttggcggaacaaattgctcctctgacagcaatgttacgttctcttcacgccgcttttcggaaataggcgcttttttgatgctgtgctgagattgaaagccgtaaaccggtgaaggaatggatgacggtttaaagggctttttcaccgtatcaggctctttatgtgtatgctgtttccgctccgtttgctccttcccggcggcataaccccgggacggctggcggcgttcgtgcctttcccgctgtctttggttttgctccgttcgcttatagccgtccggaacgaccgggaagcggaaattccctttcggatattcgtaatatattttaggatcttccatgcgcgttaatttgccttctggctgatccggtatttgctgtttctggatttgggcatgcgtgttcggttcacgttcatgctcttcttctttttcacctaaaaataagtcaaaaaatttattcagccaactcatgtttaatcactctctaactccctttttagtagtctgggacgatatttagtataccattgccgggcggctcagaaaagattaagctcccaactgaagaaagccgttaagcaggcct

SEQ ID NO: 140 - DNA, 18168 bp, Bacillus velezensis FL50S
aggtgctaccggagtaacaggagccactggagtaacgggcgcaactgggatcaccggagcaggcgcgatcattccttatgcttctggtcttcccactgccgtgacgaccattgccggcggattaatcggaacggtgagccttgtcgggttcggcaattctgtgacgggcgtcaatgtcggagggggaggcgcaattgatcttaccggggctggaggaactctgctgaactttgctttttctgctccgagaagcggaaccattacatcaattgccgcctatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacaggactgaacattgcggtaactcctcaaacccggctgttaatggtattctccgccactgctacaggcctttcgcttattaatacagtggcgggatatgcaagcgcgggagttacaatttcctgatagattgcagactgacttcggtcagtcttttttatgtgttatatcaattgtgtaaaagtaaatatatacctatcatcacctttttggtaagccgcaagagaaaaagatcacgaaaattctcaaaaatgagaaataaagatttgaaaaatggtatgattttaggaggaaaggacggctggtgctgtgttggaagcgaagcggttttatgtctctctgcaaatgaaaatcgccggattaattacggctttattaatacttgttatcggaacgctcacggttatatttgcctttcagcaattaaaggaagggcagaagcaggctgaacagctggcggtgcaaacggcaaaaaccatttcatacatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaacaaaaccgtcatgttcggcgggtctccggtttccgacggaatgaaggccgtccggggaagcgccccggttattttggaggaaaaaaatcataacgaagtcgtcggaacggtgacagtcgagtttctacaagatgagatagaaaaagatatgaaagcgcatctgcggcatttaggctattttgcatgtttggtgtttcttatcggcatcgggggagcggcggcgctcgcaaaaagcatccgtaaagatacactcggccttgaaccgcatgaaattgcagcgctgtacagggaacgcaatgcgatgctccttgcgattaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaaataccgccgaacgtggaggtgcgtgccggagataaagtatttatcttaaatgtgaaagaaatgaaacagaccggacaagtatacggagcggtgatcagcttccgcgaaaaaacggagctcaagaaactgatcaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcatgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccgtcgccgaaaaagagaaaaaagaggtatcctttttcatgaccgatatcggcagggatatcgtcatcgaagtggcggactcaggagacggcgtgcctcaggaaaaaacagaaacgatatttgaaaagggctactcttcaaaggggactaggagaggatacggcttagccaatctgaaagaagccgtcagtgaattgcagggatcgatagagatttcgcagcaaaagagcggcggtgctgtatttacggtgtttataccgaaagaaaggccaaagggggaatcggtgtgattaacatcgcgattgcagaggacgactttcgaatagcgcaaattcacgaaaaatttatcgaacatcttgatggattcaatgtcatcggcaaagcaatcaatgccaaagacaccatatcgctgcttgagaaacggcagcctgatctgctgcttttggatatttatatgccggatgagctgggaacagatctgctcccgcttatccgcggccgttttccttccgttgatatcatcattattacggcttctgccgaaacaaggctgctgcaggaagcgctcagatcaggcgttgcccattatgtcataaaaccggtgtcggcacataaatttacagaagtgcttttgcagtaccgtgaaaaaagagaatggctgcactcacagccggagctgagccagtccgtgattgacatgtttttcggaagcggtcagaaagaacaaaaacagcacaatgatctgccgaccgggattaattcgattacgcttcaaaaaatcaaaaacgcgctcagaacggcccaaaaagggatgacggctgaagaactgggagaaaaaatgggtgcctccagaacaacggcgcggcgctacgccgagtttctcgtttctcgggaagaagcgctcgctgaattagagtacggcattatcggcaggccggaacggaaatattatttagcacatgaataagggatgggagaaatgaagcggttgggagtgcttcttgtcatgctggcggcgctggtttcttttgacggacggcagatggagggcttccgctcagctgaagggccggttgaaattgtcgtcccggcagcgcctcaagggggctgggacgtaacggcaaaagctttgcaatcggtaatagagcggaagcaaatattaggccggcccgtaaagatcatctataaacccggcggaggcggagacagcggctggaaatatgtaaacgaacgaaaaacggatgtcatcagtatgaattcaagcctgctgttaagcaatgaaattttgggacaaagccggctgaaggcagctgattttacgcctttggccattatcgcaaaagagtggcagaccgtcgctcttcccaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagtaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatctgcggagtggaagcaaatgttgaaaaaacgggattgggagagcttttataaaaacagcagcggcgcaaaacgctttttagaagagcagaccgagttttataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcataataagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggtattgaacaggtggcgccgatcgcagtgatgattatgtttgcgattctttatttcggcattatgattgataccggtttatttgatccgatggtgtcgcgtattttaaagctggttaaaggcgacccgctcaaaattgtagtcggaacagccgttttgaccatgcttgtcgcactggacggagacggctcgacgacgtatatgattacgacaagcgcaatgctgcctttgtatatcatgctcggaatccgtccgattattttagcgggaatcgccggggtcggcatgggtatcatgaacacgattccatggggcggcgcggcgccgcgtgcggcgagtgcgctcggcgttgatccggcagagctgacggggccgatgctgcctgtcatcgcgagcggaatggtgtgtatgattgtggtcgcttatgtactcggaaggatggaaaggaaacggctcggggtgatcgaattaaagcagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaatgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagaccgccgtggcgtacggtgtagataaggtggaaatcgcccgcgcttcgattatcggccagccgattcatatgttaagcccgctcgtgccgtcgacgcatttattagtcgggcttgccggggtcaccattgatgaacatcagaaatttgcgatgaaatgggcggttcttgccgttatcgtcatgacggcctttgcgctcatcatcggcgcaatcacgattttttaacataaaacacccggttcgtcgcacactaaaagcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcgtcggagatgattacaaatgaaatgaaacgccggttcaaagaggggtatgagctgaaggcggtcattttgacacacggtcattttgatcatgtcggtgcgattgaagaactgcttgagctttggaatgtgccggtttacattcatgaaaaggagcttccgtacgtcacggggaaagcggattatccgcctgccaggcccgatgcgaaaaaagggcttgtcgcaaagctgtcaccgctgtttccgagacatacgatccgcattccgtccgttcaggcactgccttcagacggtaccgttccgtttcttgaagaatggaaatgggtgcatacgcccggtcacacacccggccatatttcattattccgggataaagaccgcgtgctgcttgccggtgatgccgtgatcactgttgaacaggaatcgcttgcggacgttgtcattcaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagatcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcgggaagcggaccgattttgatattctgccgctgcttttccggatgaaaggggacgggcagccggtctggtatgacctgcctcagacgctcgtgaaagaagtgccgatcacccatccggatattgaagagtttgccgatttaaatctcaggtggtacggggttccgattatcgccgatatgaggcttgaaatcggcggactgtcgtacaacgcggcgccttttaacggatggtatatgggaactgaaatcggcgcaaggaaccttgctgacgaaaagcggtatgatatgctcaaaaaagccgcttcggtcatggggatttccgccagcctgaataccgacctgtggaaagatcaggtgctggtggaactgaataaggcagtgctctattcatacaaaaaacacggtgtcagcattgtcgatcaccatacggccgcgaatcaatttaaacgctttgaagaacaggaacaagacgcgggcagaaagctgacgggcgactggacctggctgattccgccgatctcgccggcttccacccacattttccataaatcatatgacgatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctatcttatgtctgtcggcttccatctggacgaagtagcgaaaacctacgccctgaacccggccgtctgcaatcatatgatactgaagcatggaaaaaccacctttttcttactatgataaaggaaaggtaggatatttcgcaaaggatgtgaacgagatgacgcaagactattctgtcttatctatcaatctcggaaagccagcaattcatgaatttgccggcagacaaatcaattcaggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggagacgtctttcagctgggtgaagccgtcgttcaagtaagccagccgcgccagccctgcgtcaaactcgcgctcaaatatggcctcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcagacaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccaacagattggcaaggaagtactttttgaagctttgaagctttcttccttcatagtgggtaattccttttttctttaactcttctacataccagcctttactgccataatgcatgtcagaaaactcctttctccgttctcccgctggggaggtttcttcagtttttgccaaacttttggcattgtaacatctataaaaagacgctgaaaagggataatgcaaaaactgagcctttcgattcagagatgtaaagctttcttacatatatatgtaaagggcggtcttttcatgcttaatggccggttaattttaacagcaccgttccgagtgtcatgattccgaaaacgacgccgaaataaatcagcatccccttctttttcttcaccccgtaaacggtgagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattatcatccgcgatgtcccacagttcttgtaagagtttttcttccgcattgcggggctcctcgtgtttggcgagatagtccccgaggatggcggcgcttttgatgattttgctgtcatccagacccagtttttttccggcggaaattttctgatgaaggtacgccttaaattcctcgaaatcctctaaaatctgctgtttcgttacgccgtgcatggcgtgtatttcgttttcgattttgattttttctttatcttttttcatgcgtctccctccttcgggttagttgttgtatacctgttcgggagggagatgaaacattacaatgcagttaaaataatcggtttgtcttttgtgatcacgatggtgtgttccacttgggcgacaaggcttttatccggcgttttatatgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcttcatggtagacggctctgccgatctggttttgacgtttgccggcttttgcctgatccaatcctttctgaaatgcggatgccgcgcagttacaaagcttttgcagacgttcatcgccttctccgagcacaaatgaaatacccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcggaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggaccgcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagctgcccgaatatctcgggtttttcagcgggcgcaggctcgttccgattgtaacggcgctgattaccattattttggcgggtatcttcggatttgtgtggccgccgattcagtcggtgattacgtccttcggggaatggatgatcgggcttggcgggatcggcgccgggatttacgggatttttaaccggcttttgattccattcggtcttcatcatgtgctgaataatattttttggttccagtttggcgattttcacggaaaaacgggagatctggcccgcttctttgcgaaggatccgacggcgggaacttatatgacgggattcttcccgattatgatgttcgggcttccggccgcatgtctggcaatgattgccgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaacgttctcggaatcaggtcaggtttttcattctcggcgggggcaatcgattatctcctcagctacggcattgccgaaaaaccgcttttgctgctcgttgtcgggctttgttatgcggtgatctattttgtcgtcttttatatgctcatcaaaacgttaaacttgaaaacgccgggacgggaagatgatgaggaagaggaagaagtgcttagtgaagatacggccggttccgtcgaagaacatgccatgctcaaggggctcggcggcaggcaaaatctcgaaacgattgatcactgtgcgacccgcctcaggctgaccgtgcaggatacgtctctcattaatgaggcggcgcttaaaaaagcgggagcaaaaggggttatcaaaactgggaataaaacggcgcaggtcattatcgggccgaacgtcgaatttgtcgcggaagagctgagagaggccgtccgccttgacgatcagaagcagacttgaaaaatccggatcacctatgtgatccggattttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcggcggaaaacgtctggaaggcgaagacaaacgacgggtgattgatgattttaacgaagccgtgtttatcgaacggcattatatatacccaggggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtcgtcgcttattcagttctttccgacagcctgcaaaagcgcactatggctgccgccgggagctgaacataaaaaagccagatcatatcaatgatctggcttttgtttattctttttgatcgtctgctgaggaatcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcattaatctcatctttgccgagcactttcgccatcgctttattatggttttcggagatgccgtagtggtctccgtacatcacgataatcgacttatcgtacaggccgtcttttttcaggtcattaaagaactgttcaattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcaggctctttaagagcggcatggattctttgaaatacggtttgtctttcatgccgtagtttttcgtattttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttggcccgtttggtggaaaaagttatcaaagtagaatgtttgattatcgtgcgccagtttgtttaaaaacggcgtcacttccttgccgttaattttgtaatcaatgataaaggactgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgcccaagtatttcaccagatagtttcggtcaaatgagcgtgtcaaaagctcgggacggtcggattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaataaaaaatgaatcacaataatggctgtctgctgtaatttcttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcagcggcggttgatctgttgaatgacagctttaaaaaacacaaatggcacaaactgggatgtgaatttccgtatgatcacacccgattctattgaagaaagaggtgaacagtgatggatattgcgcatatcgtggctgaagataaaatcaagcgcgccattaaggatggagagttcgccggcatcaatggaatgggaaagcccctgccgaaagacgatgccgcacatcttccggagtcgctcagaatgggctaccgcatattaaaaaacgccggaatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtatacagacggctgggccgcccgtaagccggctctttatatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgtttgtaatctcaagccactttctcattttttcgatatccacttcggcagaacctccctatatttgatttgcgatcggcattgacgggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaattccgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcataaacatgtatatacaagttttttgagacaaaatgaaaacggttacggaggggttggcatgggtgagtttaaccgggctgcgcggcagatcgctgaagctgtcggcggaatcgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatcggggaagcgtccaaggatgacgtgaagaaggcggcatcgcaaaacatgaatcctttacagcgtgctgtgaaaacgcttgcggacatctttattccgatcttgccggcgatcgtcacggccgggcttttaatgggtctgaacaatatcttaacggcggaaggcattttctacagcacgaaatcgattgttcaagtgtatccgcaatgggcggatcttgccaatatgattaatctgatcgcggggacggccttcgcttttctgccggctttaatcggctggtcggcagtgaagcggttcggaggaagcccgcttttgggcatcgtgctcgggctgatgctggtgcatcctgatctgttaaacgcatggggatacggggccgccgagcagagcggcgatattccggtgtggaacttgttcggccttgaggtgcagaaagtcgggtatcaaggtcaggtgctcccgattctgctggcgtcttatttacttgccaggcttgagctctttttgacgaaacggacgccggagggcattcagctgttggtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtcatcacggggatgcatcatacgtttctcgcggtcgatcttcaattaatcggatcaaagctcggcggcacatttttatggccgatgctcgcattatcaaatatcgctcaaggatcggcggctctggccatgatgctcattacaaaagataaaaaacagcgggggctttcactgacggccggcatttccgcatatttgggcattaccgagccggcgattttcggcgtgaatctgcgttacaaatttccgtttgtgatcgccatgatcagctcggggattgcggggatgttcatctccgtcaaaggcgttctcgcaagctcggtcggtgtcggcggcgtgccagggatcttctccattatgagccggtactggggcccgtttgcgatcggaatgctgattgtgctgattctcccgtttgcgggaacatacgggtatgcgcggctgaaacggcaaaaatagaaaacctgcggggcgccttctatcaggctgtcccttttccctttccattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttctcgatgaagcgcacaaaagaggaataaaggtcgtcatggatcttgtcgtaaaccatacatcagtcgagcatcagtggttcaaagaagcggtttcgtcacccgacagtccgtatcgggatttttacatttggaaagacggaaaggaagacggccgggcgccgaacaactgggaatcaaa

SEQ ID NO: 141 - DNA, 16890 bp, Bacillus velezensis FL50S
tgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttacaagtattgcttcaggaaattagaaacgtaatacggaaatttgcgttccgtgacctctaagaaccgtcggatcatcacataatcatcactgacatgctgtgtcagcagttcataccaccactccgtttcatatctcgcaatcatcccgatattgtagaggaccaaataatgaataatcatttccggaagatgcaggaagtgatcacgctgagagggaatgtaatattgatttttctccaagtgaaacaataaatttggagaagaccaaggttccctgtctatcgggtcagcctcaaaaaccaagtggttatggtctttcctcagaaaagaccacttcaaatgatggctgatatattcagcaaagcgggaatcagacatattgtaatgaatcaccgcatgctcaggcactgaaataaggtcatctttcagttctacttgggtcagccaattctttttctcttggaagtaaaagacagtttgcaattcaggtatggctgtcagcaatttcttcattgtgtaccgttcttcctcaagaccagctatcccgaataagtgcttcattacatgaatacataagccattgcgctgcaccttcacttcatcatccctaaaggagtaattttgctttttgcgtttccgggcagtcacgccatgcgcgagtactgaagcgtggcttggatagcttggatctgtggtcagaaggcaggctttcagcaattgtgacatcccgtaaaacaacagaataggcttaatttctaaaggagaaagagatgcctgcttataaaaggactcggcgtgtttgataaagaatatgaagcgctcactgttcttaaacgcatatcgttttggttcctccatgccgctttctgtatagactttgtttagaaatttctgggaagattctacggaataaaataatgataactctttcaactcatgatctctcatatgtatttttaaaccctttcctttatctaaatatttcaactctttttcgcttccttgacatgctgttttctagttgataatctacatataatattttgccgaaaagagggggatttactaatgtgggaaagtaaattttcaaaagaaggcttaacgttcgatgatgtactgctcgtaccggctcaatcagacgtacttccgcgtgatgtggatttatctgttgaactgacaaaaacgttaaagcttaatattcctgtcatcagtgcgggaatggatacagtaacagaatcagcaatggcgattgcgatggccagacagggcggcttgggcattatccataaaaacatgtccatcgaacagcaggctgaacatgttgacaaagtcaaacgttctgaacggggcgttattacaaatcccttctttttaacacctgatcatcaagtattcgatgcggagcatttgatggggaaatacagaatttccggtgttccgatcgtagataataaagacgatcaaaagcttgtcggtatcattacaaaccgtgatcttcgctttatctctgattattcaatgaaaatcagtgatgtcatgacaaaagaagagctggttacggctcctgtgggaaccacattagacgaagcagaaaaaatcttacagaaacataaaattgaaaaacttccgttagtggatgaccaaaacaaattaaaaggtcttatcacgatcaaagatattgaaaaggttatcgaattccctaattcatctaaagatgaacacggacgccttattgtcggcgctgcggtaggcgtgacaggcgatacaatgacacgcgtcagcaagcttgttgaagcgaatgtcgacgttatcgtggttgatacggctcacggacattccagaggcgtactgaacacagttgcgaaaatccgtgaaacatatcctgaactgaacattatcgcaggaaatgttgcaacggctgaagcgacaaaagctctgattgaagccggagcaaatattgtcaaagtgggaatcgggcctggttctatctgtacgacacgcgtcgttgcaggtgtaggcgtaccgcagatcactgccatttatgattgtgccactgaagcgagaaaacacggcgcgacaattatcgcagacggcggtattaaattctccggagatattacgaaagcgttggcttcaggcggacatgccgtaatgctcggaagcctgcttgccggtacttcagaaagcccgggagagactgaaatctatcagggcagaagatttaaagtgtatcgcggtatgggttctgtcgctgccatggaaaaaggcagtaaagaccgatatttccaagaagaaaataagaaattcgtccctgaaggtatcgaaggacggactccgtacaaaggtcctgtagaagaaacagtgtatcagcttgtcggcggtcttcgttcaggtatgggatattgcggttcaaaagacttgcgcgctttaagagaagaggctcaattcatccgtatgacaggtgccggtcttcgcgaaagtcatccgcatgatgtccaaattacgaaagaatcaccaaactacacaatctcataattgttacaaataaaaaacatttgacagggtcgctgactctgtctattttttttatatcgagtgtgataaaatttatactgttgtgttttgaatttgaatatgtccttaacggcttaattatagatttaaaatgaatgacggaggtcgtaagattgaacatcacgaaatggaaacagctgttggtgtcattagtggtactggcactggccgcaacttgctttgttccgatgtctaaagcggaggcagccggcaatgacccgattgatgtcaacgcatcagctgcgataatgattgaggcttcatcgggaaaaattttatacagtaaaaatgcagacaaaagactgccgattgccagcatgacaaaaatgatgactgaatatctgcttctggaagccattaaagaaggaaaagtgaaatgggatcaaacgtatactcctgatgattatgtctatgaaatttctcaagacaacagtttatcaaacgtcccccttcgaaaagacggcaaatacacggttaaagaactgtatcaggccatggcgatttactctgctaacggagccgcgattgcagttgccgaaattcttgccggaactgaaacgaaatttgtcgctgaaatgaatgcgaaagccaaagaattaggcatgacaaactatgattttaaaaatgccacagggcttgtgaatgaagatcttcacggcaaacagccgcaaggagaaggcgttaaagaagagagtgaagtttctgctaaagacatggcgcttcttgcagaccgcctgatcactgattatccggaagttctcaaaacaacaagcatcgctaaaacgaaattcagagccggcactgatgatgaaatggacatgccgaactggaacttcatgttaaaaggtcttgtttctgaataccctggcgttgacggcttaaaaacgggttctactgattctgcgggatcttgttttacaagcacagcacagcggaacggaatgcgggtcatcaccgttgtattaaacgcaaaaggcaacctgcataccggacgttttgatgaaacgaaaaaaatgctcgattacgcatttaacagcaatttctcaatgaaagatctttaccctgaaggctctcaagtaaaagggcacaaaacggttgacgttgaaaaagggaaagacaagcaagttgatattgttactgacaaggcgctttctattcctgtgaaaagcggggatgaaaagaactataaagccgaagtgactatagataaaaaagaaatcacggctcctgtgaaaaagggaacgaaagtcggaacgctgacagttacatacaaaggcagtgacaaagactatggcttcctcaaatccaaagagttcagcgtgaatcttgtaacgaaaaatgatgtagataaagcaaactggtttgttcagatgatgcgcggcatcggcggatttttctccggtatctggaacagcgccgttgacacggtaacaggctggttttaagaaataagaaagagctctgatgaaagttagggctcttttgcttaatatactgaaaaaaccaaattattagtaaaaaaatgatatctatcttattcatctcgctgtaaaataagaatacccatatgaaatattgtatttctgggatacaataagagatagacattatctaactatacattgactagggggaccaaataatggctcaaacaggtactgatcgtgtaaaacgcggcatggcagaaatgcaaaaaggcggcgtcatcatggacgtagtaaatgctgaacaagcgaagattgcggaagaggcgggagctgttgccgtaatggcgttagaacgcgttccggctgatattcgcgctgccggcggtgttgcccgcatggctgatccgacaatcgttgaagaagtaatgaatgctgtatccattcccgtaatggcaaaagcgcgtatcggacatatcgttgaagcgcgtgtccttgaagcaatgggagtagattacatcgatgaaagtgaagttctgactccggctgacgaagaatttcatttaaataaaaatgaatatacagtcccgttcgtatgcggctgccgtgatctcggcgaagcaactcgccgtatcgccgaaggagcttccatgcttcgtacaaaaggcgaaccgggaacaggaaacattgtggaagctgtccgccatatgagaaaagtaaacgcgcaagtgcgcaaagttgttgcgatgagcgatgatgagctgatgactgaagctaaaaacctcggcgctccttatgaactgcttcttcagatcaaacgtgacggcaaactgcctgtagtgaactttgctgccggcggagtagcgacgcctgctgacgcggcattgatgatgcagcttggcgctgatggcgtatttgtcggttcaggtattttcaaatcagacaaccctgctaaattcgccaaagcaattgttgaagcaacgactcattatacagactacaaactgatcgctgagctttctaaagaattaggcacagcaatgaaaggcatcgaaatctcaaatctattgccggaacagcgtatgcaagaacgcggctggtaaaaccataggagagctggaagcatgttaacaattggtgtacttggacttcaaggagcagtaagagaacatattcgttcaattgaagcatgtggttcaaaaggtgtcgtcattaagcgtcctgaacagctgaatgacatcgacggcttaatcctgccgggcggggaaagcacgacaatgcggcgtttaatggatacgtatcattttatggagccgcttcgcgagtttgccgctcaaggcaagccgatgttcggcacatgcgccggtctgattatcttagccaaagagatagcgggaacggataacgctcatttagggctgttgaacgtagttgtcgagcgtaattcctttggccgtcaggtcgacagctttgaagctgatctgacgattaaaggccttgatgagccgtttacgggtgtatttattcgcgcaccgcatattttaaaagccggagaagatgttgaagtgctttgtgagcataacggacgcatcgtggctgcaaagcagggaaatttcctcggctgctcgttccatcctgaactgacggatgatcaccgggtgacagagctgtttgtgaagatggcggaaaagcataagcaggaaacagctgtataaaacagttgaaaaccgctgatacttatagtacattataatcacaaataaagatcgaaaagcgttgacaggaagcagtaggaagcccctctttcaaagagagccgatgggtggtgcgaatcggtgaaagatgctgtccgaatccgtccttgagcgaaatgctgaaaacaagtaggcatttacgggaaaaccgttatgtgttaaagcggaaagcaagtgtgagcttgttttcaatcagggtggcaacgcgagagctctcgtcccttttaggggatgagggctcttttttattttcgataaaaacagataggagttgttaggcatgattgatacgaaggtgctgagagccaattttcaagaggtaaaagcgaagctcattccaaaaggcgaagacttatctgactttgacaagtttgaagagctggatgaaaagagaagagagcttatcggtaaagtagaagaattgaagggaaaacgcaatgaagtgtctcagcaggtcgccgttttgaaacgggagaaaaaagacgctgatcatattattaaagagatgcgtgaagtaggcgaagaaattaagaagcttgatgaagagcttcgtactgtcgaaacgacgctcgaaaccatccttctgtctattccgaacatcccgcacgattcagtgcccgtcggagaaacggaagatgataacattgaaattcgcaagtggggagaggcgccagcattttcatatgagccgaaaccgcattgggatatcgcagaccgcttaaacattcttgatttcgaacgcgcttcaaaagtaacaggcagccggtttgtgttttataaaggattaggcgcccgcctcgaacgcgcgctctacaactttatgctggatcttcacgtggatgaatatgattacacggaagtcattcctccttatatggtaaaccgtacgagcatgacaggtacgggacagcttcctaaatttgaagaggatgcttttaaaatcagagaagaggattatttcttaattccgacggcggaagtgccgattacaaatatgcaccgcgatgaaatcttatccggtgagaacctgccgatcaattatgccgcgttcagcgcctgcttccgttcagaagcgggatccgccggccgtgatacacgcggtttgatccgtcagcatcagttcaacaaggttgagcttgtaaagttcgtgaagccggaagattcttatgaggagcttgaaaaactgacaaatcaagctgagcgggtgcttcagctgcttgaattgccgtatcgtgtcatgagcatgtgtaccggtgatctcggctttacagctgcgaaaaagtacgatattgaggtttggattccaagccaagacacatatcgtgaaatttcttcttgcagcaactttgaggccttccaggcaagacgtgcgaacattcgattcagacgcgaagcgaaaggcaagccggagcatgtgcatacattaaacggttcaggtcttgcagtcggcagaacagtagctgccatcttggaaaactaccagcaggaagacggaagtgtcatcattccgaaagtgcttcgtccttatatgggaaataaagaagtcatcaaaccataaaaaggtgcgccctagaggcgcgccttttttgctgcccagtatagagcggcggcattccgagctgtgctttccaggttaaaacagccggatgctaaggcgtcttcaagacttacagcaccgggcacgatagaaaatacagctgttattcctgcgctgtaaacatgctcgaaattttcgcctaaggagcccgccaatgcgataacgggaatttcttgagcagctgcgcgtgcggcgatcccggcgggggttttgccgaatatcgtttgtccgtcaatctggccctctccggtaatgacaaggtcagcatctcttatctgatctgagaaggacagtgtatctaatacaacgtcaatcccgctttgaagttctgcctgtaagaaagcgatcagtccagcgcccagcccacctgcggcgcccgcgccttttacggtatccgcttcgatatcgtgctgacgcctcaatacgtcagcgaaatggtataaattgcgatccaatacaactttagtcttctcggacgcccctttttgcgggccgaagacatatgacgcgccgttttcaccggtcaggggattttcgacatcacatgcggcacgaaaacggatatgtttcagatcaggggagagcccgcttatatcaatagaagctagggtgtgcagagcgcctccgccgtcatgtatctcctgaccttcctcatttaagaaacgcacaccgagcgcgctcgccattcctgttccgccgtcattggttgcactcccgccaagcccgatgatgatctcactcgccccgcgggaggctgcatccgctatcagttcacccgttcctcttgtcgttgtgttcaacggatctctgagatggcggggaacgagatggagtcccgatgcttccgccatttcaatgactgccgtgcgtccgtctcccagaagtccatatgcggcgtttaccggcgttcccagcggaccggtcacagtttttttgatgatgcttccgccagtggcatccgtcaaagcctgaacggttccttctccgccgtcggccgcgggtatcttggtatattccgcgtcagggaagaccgctttgaatcctttttctatgctgtcagcggcttcttttgatgtcatgctttctttgaaagaatcgggtgcgatgatgattttcattatgttctccacctttatgagcaggttatctgtttgaatctattcttgattttcactgtgttttcctgcccgtatggcatactgaagttgaattggacgcaagacttttgtatgatagtaaagctgacggaaaagctgtttaagaaatgaaataaaaaatatgaaaaagcgcttgactgaaatttgggtcatgtggtatattattaaatgtcgatacggaggaatacccaagtctggctgaagggatcggtcttgaaaaccgacaggggtgtcaaagcccgcgggggttcgaatccctcttcctccgccatattgattttaaacctaatgaaactcgagcatatattggagattgttttgtccgctgcatctgatgcagcggattttttatatgcaaaaaaagcgattttctctgttcggggaaaatcgctttgctatttttatttgtttctgttttcgttgatcacgtgactgattttttcgatcaaaggttccagtgactgttcatcagcttcaaggtcataatcttcaatgcgtactttcagtacagggcaggcgttaaaaccgctgatccagtcttcgtaccgtgtatacatctcttcccaataggagcggtttgtctgcagctccatctcgcggccccgcttttcaatccggcttataatgtattcaaggtcgccttctaaatagatcaaaacatcaggatgcgggaaatacggcgtcatgaccatcgcctcaaataggcttgtgtatgttgtgtaatctgtcagcgacatggttcctttatcggcatgcatttttgcgaatatgcctgtatcttcataaatcgaacggtcctgcacgaatccgccgcctgattcaaacatgtttttttgctctttgaaccgctcagccagaaaataaatttgcaaatggaagctccagcgttcaaaatcgtgataaaacttctctaaataagggttttcatccacttcttcaagtgaggtatgaaacccgagccgttttgctaaagctttggtcaaagtcgattttccgactcctaccgttcctgctactgttataatggcgttgtttggaatatgaatgtctttcatttaatatgctcctttacctgacgggcaattctttcatagtctgtcttattcaaaacaaagtcttcagtatcaccgtcaatggtcagtacagatatatccggatcttcttcctgaagctgtctgatggctgtgtcgtaatctgcaatgagatgttccagatattgatgttcgatatttttctcaaacgggcgcccgcgtttttcaatgcgttgaagcaatgtcggcaggcttgcctttatgtatacaatgatattcggcttcggcaggtcgtgagtgagcagatgatagatctgcttatacttctcaagcttttggccgtgcaatgtacgctctgcgaaaataacatttttataaatatgataatcggacaaaacgggctgtccttgttttaaataatctcgatcggtgtcttcaagctgtttatacctgtgacatagaaaaaacatttcaagctggaaactccactcctcgatattgtcataaaacttatcgagataagggttgtcttccacaatctcattaatcataggaaaaccgagctcttcagaaagcatcgtagcgagtgtcgtttttcctgccccgataggaccttctaccgcgataaaaggggctctgttcattgaaaatcctccttaattctgcaaacatccgtcagctgccggcctttatattgtatcacactcacagaaaagcccatgaaaaaagacgctcccaattaacgaaacgtctcttttacaatatgaaattgatcgccgagcaaaagccagttttgcgggaaagaaaggccgagtttccaatagctgattcctcttaaatgaagttctttaattaaattgaatttcgcttgaatggatcgtgcgtcttcaaaccatacttcatgccgtctctgatttgcatccgtgtatcggaagaagggagcctgggcggtttcgtcatattgaatgtcgactttatagcgtgctgccagagcgattgcctgctgaggactgacggctttcgctgtcgttccctgtttgaaaggcagtgtccaatcatagccgtacatattctggcccatgacgatttttgaagaaggcatttccgtcagcgcgtactcaatgacatttcttacagggccgataggtgatacggcctgagccgggcctccgctgtacccccactcatatgtcataatcacgacgaaatcgacgatttctccatgtgccctatagtcatgagcttcgtaccatttgccggcctgagtcgcgctcgttttcggagcaagcgccgttgaaatcttccagccttcccgatgaaaaatcgttctcgcttcacgtaaaaaacgattgtaggcttccctgtcctgtggacgtaaatattcgaaatcaaagtgaatatcgcgaaagccgtactttttagccgtggagacgatttcctgaaagagttttgttttcactgtattgtcgttcaagatgagccgcccgagttcatcgctgaatgcgtcattttcaaggttggtgatgatcatcatcagtgtggtgttgtgcctgtcactgatgctttttaaattggtcagaggcggttcctttaaagtcccgttccgctgcacttgaaaactgaatgcgccgaggtatgttaaataaggagaggcctcccttgccgcctgctgaagattagcgcttacgctcgttccccgcggttctatatatgcgtttgattcgatatcgggcttattcgcctgctgcggaatgtaaaggcgggttccgactctcaatgtggtgccgggctgaattccgttcaccctcgcaagctccgcggccgatatatgaaaacggccggcgattgacgcgagagtatcaccttgttttacttcgtaatattgaccctcaatcgggatgacaagggtttgtccgacaaccaatgtattgggattaggcagtttatttgcttccgcaatgacatttgcggctgtccggtagcgcgccgcaatagcggaaagcgtgtcgccccgtttcactatatagatctgaatgaaaaacgcctcctttcatatccgctatcaaatatatgaaaaaaggaggctgatcatgtttatttttcggcggtaatttgtttttccgtggttatttctgcgaagagaacattctccatcatggtcaaagcgaaatcattgtcttcgtcgttattggaagcggtgcagtctttcggaatggcaatgctgtattctctcatataagcgtcgttggccgtgaacagcacacaaatgttcccggcaatccccgtgatgattaatcggttcacttgtaattcggtcagaagggtgtgaagcgccgtttcgtaaaaagcggaatgcttcggtttaatgagaaaataatcatccggctgaggcgaaatatcttttataatggaggcgcttctgtcgttgctgcattcctccctgatggcatcaatatcagccttccagagcccgtaatgatcattaatataaataatcggccagttgctttgttttgcatgcttctttaatgataaaatacgggggacaatttgtttggttttttcagcaagacgttcgcccatatcaaattgaaaattgttgatcatatcgacaatcagaagggctgtgttgttaggttcagacaataccggcaactcctttctgctggggtattcctattttaacctttatgagacatgaaaaaacttaagaagagagctcgaaccgatgaatgatgaatattatatgagagaagccataaaagaagcgaagaaagccgaagagaaaggtgaagtgccgatcggagcagttcttgttctgcacgatgagatcgtggcgcgggcgcataatctgcgggagactgaacagaggtcgcttgcccacgccgaaatgctggcgatagacgaagcgtgccgtaagctggggacatggagacttgaggatgccgttctctatgtcactttggagccgtgtccgatgtgcgcgggagccgtcgtgctttcgagagtcgataaggtcgtattcggcgcatttgatcccaaggggggctgtacaggaacgctgatgaacctcttgcaggaagagcggttcaaccaccaagcggaagtggtgagcggcgtactcggagaagagtgcggagaaatgctcagcgcttttttcagaaagctgcgccggcaaaagaaagacatgaggaaaaagttgtctgagtagtacggttgcattttctgcctgaagcagatatacttatgtgtgcatcatgaatggtgcgcatatcaaaatttgatatttattttgccgtgctaagcggggaggtagcggtgccctgtacccgcaatccgctctagcggggccgaatcccttctcgaggttcgtttactgtaaggtctgccttaagtaagtggcgttgacgtctgggtcctgcgcaatgggaattcatgaaccatgtcaggtccggaaggaagcagcattaagtgaaacctctcatgtgccgcagggttgcctgggctgagctaactgcttaagtaacgcttagggtagcgaatcgacagaaggtgcacggtaaatcaatcatcaaatttcagactcacctgttatggcaggtgagttttttcgtatatgaaaaacgggttttggcgttaaaagcacgttcatgtataataaacatgatgaataacagaggagggcgcatcctgtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcatgcaaggggatcacaaatggctctatatcagatgtgattgaaatagatgcggcgtcgaataacggcgtagacgaaatccgcgacatccgtgacaaagtaaaatttgccccgtcggccgttacttacaaggtatatattatagatgaggtgcatatgctctctatcggcgcatttaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctcttcaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggcccccgctttatatgagatgattgatatcctgaataaaagccatcaggaaatgaagtggacgaaccacccaagaatcttttttgaagtggctgtcgtgaaaatatgccaaacggcacagcaatccgccggagacatccctgaggtcggcatgctgatgaataagatccagcagcttgagcaggaagtagaaaggctgaaaacctccggtgtgaaggttcagatggaaagcgctccgaaagaagctccgcgtcctcaaaaaggcggaaaaagccattataaagccccggtcggaagaattcatgagatattgaaggaagccacaagacctgatcttgaacagcttaaaagcagctggggcaagctgctggcacacctgaaacagcagaataaggtgtctcatgcggctcttttgaatgacagtgaaccggtggccgctgctcaaaaggcatttgtgcttaaatttaaatacgaaatccattgtaaaatggttgcagaagacaataacggagtccgtacgaatcttgaacagattctcgaatcaatgctcgggaaaagaatggatttgattggcgttccggaagcacaatggggtaaaataagagaagaatttttaaatgatcaccagcaggaaagtgaaggatcaaacgaaccggctgaagaagatccgctgattgcagaggcgaaaaaacttgtcggagcggatttaatcgaaataaaagactaataagatgaaagagagtgattgaatatgcgtggcggaatgggaaacatgcaaaaaatgatgaaacaaatgcaaaaaatgcaaaaggatatggcgaaggctcaggaggaacttgctgaaaaagtgctcgaaggcacagcgggcggcggtatggtgactgtaaaagtcaacggccaaaaagaagttgtagacgttgccattaaagaagaagttgttgatccggaagatatcgaaatgcttcaggacctggttcttgctgcgacaaacgacgccctcaaaaaagtggatgacatgacgaatgagacaatgggacaatttacaaaaggaatgaacataccgggtttattctagggggataaataaacatgcagtatcctgaaccaatatcaaagctgattgacagctttatgaaattgccagggatcggaccgaaaacagcggttcgtctggctttttttgttctaggtatgaaagaagacacagtattggattttgctaaggcgcttgtcaatgcgaagcggaatctgacatattgctcgatttgcggacatattacagatcaggacccttgttatatatgtgaggacacaagaagagataagtctgttatttgtgtcgtgcaggaccctaaggatgtgatcgcgatggagaaaatgaaggaatataacggccagtatcatgttcttcacggcgcgatttcaccaatggacggcatcggtccggaggatattaagattccggagctgctgaaacgtcttcaggatgatcaagtgacagaagttattctcgcaaccaaccctaatattgaaggggaagcaacagcgatgtatatatcaaggctgttaaagccctcaggcatcaagctctcccgtattgcccacggtctgcccgtcggcggtgatttggaatatgctgatgaggtcactctttcaaaagctcttgaaggaagacgtgaattgtaagggaggaaaaggcaaggcatgggttttcttcgcagaaatacattaagaaaagagtttgacgagaagctgatagaacagctatttaaacaaaaagaagaatggaacagacagaagagtctggtcgagaaaagtctagagccctccgctgaggtgttgtttgagctgaaagtcgctgaatctaagtactttttttatttgaaagaagcgaagcagcggaatttgaaaatgagcagatggaagtaagaggtctattctccggaatcttctcataagcttgtactaaacaagcgagggggaagattcatggagccttttttcattatcggtttgattgtcggtctggttgctttgctttttttatggggagtatcttcaaaaccgttaaggtggattggtgtgactgccattaagtttattgccggcgcgattctgttggtgggtgtgaacttgttcgggggcagtctgggtattcatatccctgttaacctgattacaacgggcatcagcggaattcttgggattcccggtatcgcggctttgatagtcattaaacgcttcatcatttaatttgtcgattattgttgacatgttggatcaagggtggtattctaatatacgtcgctgatgacgaaacgaattcttgaaaaagaaattttaaaaagttattgacgacaatgacactgagatgttataataattaagtcgcttcaagagcgatggacaaagttctttgaaaactaaacaagacaaaacgtacctgttaattcaaagttttaaataaatcgcacagcgatgtgcgtagtcagtcaaacta

SEQ ID NO: 142 - DNA, 16458 bp, Bacillus velezensis FL50S
gccacttcatatgaagtggctttctcttcaaagacgcattcgattgtcgggtctacggccgcatagcccggattagtgatagtctgaatacctgaattaaattcaaaatccttcgccgggccgtatttttttggatcaggacagataaaagtcaatgttgcagtctgaaagcctccctgttcttcgccttctgaaatgctttcaaagacagcattatagactctgtcaggctcatcgtgaaaaattaacggtttaggttcttcggtgtgcagaataaaagtcagttcctcctgctttttcttcagctcttcttcactgctgaaagcaaaaagaacctcaacggttatgactcttacaggaattcttgtgttccgcaggaaaccgccggggcgattcccgatagtggctgtattcacttctcttccggtcactccccggccgcccgtggacttcacataaaagaagggtgatatatcaatgccgtcaaacgtgattttccattgattaggcagcagttcctgataattgatcaattaaatctcgtcctccttgcgttcgaccttttctgagcgtctgtgaccggtttttctacgccttgaccgaccttcttgctgtccatctcaacaacaatcatcctgtcaggcaattcaaggttccggatgtccgcgctcaattcttttctaaccgtgccgagttcgctgctggaaatggatgtgtcatatgcaaaattcagatcctcctgctgaatagtcatggcatcactgacgacgcccatagctttctgaacagtgccgataccattctgaatccccacagcgataccggcaggaaccatgaccccgacctgatcccgcatcaatctggatggggaatggattttcaatttcttcttaatcgttttttcaattgtcgaggcgatggaatttgcttctttcgccagctcgcccttcatattcttcattccagaaataatgccggccattgtatttgaaccgatggcttttccgcttttcttgagagaaccaagctgttttacatccactgtaagctccccaattttgcggagatagtcatttttcaaaagtgccagttctttatttgcggcagaccgtaattcatttattttcttggtcgtcgcgttcttcaacccggttaattcttgagcagcctggtcactggccagcttgtgcttttctttccacagactgacatactcatttagctctgaatctgtcatgcgggctattgcattaatctgatcagctgacccgacacccatttctttcaattcgtctgtgaatgcctttggtgcccggcttgctatttttgtaatgtcagtgttgaacgttttgatcttgtccagctgatttttaagatttgaagtcagcttggagccgttcacattttgacttgagacatcgtcaaatagaccgatggcgttataaatcgcgtcagttcggtcttgcagctcctttttataggcatcgttggccgccttaatatcggcagtcagtttatcattcacttttttgaattttgagagataagtattgtttgcagaaagaatgcccttgttaagtttgtcagccgctttcttttcggcttctttctgctttctggccttatcagccatcgttttttgagtctgatatatttcccgttgaacctttatttgctggtcagaattcagcttgttcttcttcttaattttctcaagcgttttgatataggtattcccgctgatttttcctgtatcgtattttgcctcagctttcttaatctgatctgatactttcttggtatacgccagtttcgccttcgcttccttgcgctgctgctctttcagtagcttcttctgtttatcagaggcgcttttggatgcctgatatatctcgcgctggatttttcggttttgctcactggtcagcttgttttgcttctgaatcttctgcaatgttttgatatacgtatcggcgcccattttcttggtgtcatacttcacttcagcgttcttaattttgttggatacctttacctcagccgccttctgagccgctttcgctgcttttgccgcagccgcttttacttttccctgtgatttatcaataccagccgccataccggtgccgacgtgataaccgacctggtcacgcattacccttgatggagaatggattccaagaagttttttcatgccgttaggaatagcatttgccattgatttcactttgctcgctaatgctcccgccatgccgctgataccatttattaagccttggatgatgttcttaccgatctgccacaagttaatgccgcggaaaaacttcatgacaccgttccatatgcttgtaattgttgattttgctgatttcattatgccggaaatagcatttttcatactattgaataggcttttagctgtactcacgagccctttccagagccctgtaacaaaacctttgacggcgttccacacgcttgtgaaaacacttttggtgccattcagcatgccgctaaaaaatgacttcaatccattccaaatgctcttggcagtagaagatacagctttccataccgtggtaacaacagtttttatcgcattccaaacggtgctgaagattttcttttgcgtatttaaccaactggtgaagaaggttttcaacccattccagattgattttccaactgatacaacgcccttccagatcgaagtagcaattgttttgatgccgttccaaatgcttgtgaatgcagttttcattccattccagactgatgaaaagaatgttttcaggccgttccaaatggttttagctgccgatacaattccattccaaacagtagagaagaacgactttattccgttccatgttgatattgctatcgtctttatacctgtccagacagtagacaaccaactggaaatagccccccatgctgcaattgtagccgatttcaccgtgtcccaattcgcaatgatcaaggcaaccagaccgatgacagccgctgtaatccatccgataggccccattgcgatgacccatgatgccgccatacgtgccgcctgtgctgccgcttgtgccgcaagcacgacgagttgccggccgaataaaaccatttgcttaccgcctgcaaccaacaaagatataaaattgctgatctgcgccgccgtccaagccgctgccatgcgggttgcctgtgctatggattgcgctgcaagcacggtcatcttggcaatgaaaagacccatctgcttaatcccgtttgtcagcattgtgataaaagaggtgatcttcattgctgtccatgcggttgctgtacgggcagcacttgcgattgattgagcagccattacagtcatattcttgatccataagcccatttgtacgatgccgcgcttcagagcagaaatcaacgacgatattttcatagccgtccaagcagcagctgtcctagccgcttcagctgttgttttcgccgctaaaactgtgtactctgctatgaatttaccaacccaaactatgccggatttcaattgcgatatcattttagcgagtgtgaatccttctgttcctgtgacgaatttttttacccatttagctgcagttaaaaaatcctttaagccgtttgtaacagcgctgacggctactatcgcaggaacaatagctcttaacgcaccgattaatgaaatgcccgccgcaatgaacttcccgattgccgggtttgcttccatcgctgcattagtaaatttcaaaaacccgtttacattctccaaaatcgttttaccgagtggagccatgccaacaagcaagttgatgatagtttttgcgatctgccccaatgtgctccatactgtaggaccgttggttttgatatagtcaatgaacgattgaaattcttttgttttcgtaacgctcccagcccactcattgaaccgcttggtcagatctacgagtgatgtcatcatgtcttgtgacataggagcgaatccagtaaacagctttgtcaggccgcccgaaaagtttctgataatctgcaacaattttgggccgttggtttttgtatactccacgaaagcctgaaatttctttgaagaacccaagtttgctgaccatttcacccatgattgggtcattccttcgatggattttgtcatgctctttccggtcggtccgaatgctacgatcagattgaaaactgtccgtaagacattcccggcagatcggccgaatgaagcaaacgccgacggagcttctttgttcagataagaaatgaatctctgcatgtccggagctttaaaagctttgtccatgcttttcgccagtcccacgccctcttttgccagtccatcaaacattggaatgagtgagttgagcgcgagtttaaacgtatttagagacataccgaatgtttttaagatcggcttttgaaccatcgaaccgatgtcccgccaattgtctttgaagtcttcgaggttctttaatgcctctctctcttcttttccaagagatttttgcagattattgatctgtttcatgattttagcgcgctcttttgcgcttgttgcattgtccagcttctcctgcagctttgaaaggtcttcggatgctttaaatacaccgcttattgaagtaacagcaagggcgccgaatgccgccgcgcctgttcccgctgttgcaaatgcactggttaaccccattactccgccggctgccaccccgagcatagggcccaatgacccgattactccggttatgctggcaagaaccggagaaattgcaggcaatgcggatgtgaaggcgccggcaagcgaatgacctatgacagttgaaacagagttagtgattttggcgagcctgttcattgatgtttcaaaccgatcaattcgggcttcgatgtgtatccaaacacgttttggcaaggaatgtgtctctgttctggctactgctaccgctctcgttaaattcgaagtatcaccgtttatgttggttgtgactctatttcgcaacgaagctaaagctgtccgtgcttctgacacagctctagtcagaggatctgaatcagcatctaaatcaactcgtgtgcgttcatgccgatgtacaaaattatcaatttgctgctcggcctgccgcactctggcctgaaagcttgcgatctctgcatcgatttccaccgtctgatgatcattcatccggcgcatcatatcattcacacgatccatgctgcgagtaaatcttcgtgtctgtgcttcaactattgctgtcagtctttcgatcattccctcaccccattccttgtccgaattttgcaaagtggttgcggattgcatcattaaaccgctgaacccctttggctcgtttgccgagctcgtttacatctgtcttacgccatttgtcgttatccccagtgatattccgctccaattgacgtctggccttattcgcatcaaacattttcttttctttggggcgcttctcattcatagcgtaacggtgaaacatggcgtttcttgccataagctccaattcatctatttctcgcaacttggcccctttgagcagaagcttgtactcgttaggagtccatgacatgattaaatccacatcataaaccccaagccaatgtgcggaattcgtaattatttggtcatagtcgatcccgttctctctttgtacgcctctttcatcatcttcaggacctccttgccgttctcttcgtcctccagccgtttcgcttccatttccggtgtttcgttcggagccggtttcttccctttgttcatcttctccatcatcttccatcgctgacggatcacgcctttgaaaaaacccgctgagtccagtgtcgtgaatgcttcattgatcatcttgtcaattgcctcgcctgtctcgtcttcatcaatgattttcatgattgcttcttcaatagcctcagttgaaggcttttctttcttcaagtaagcaagtgcgcaatcccaaaaagcagaaagataggaagcctcttcgttgagcaggctcatgtaaatattcattgtgccgcctttgcccttttcgtccgcagtggaatatttttcgtttgccaatctgtcaaaagcaaagtcgcagcgtgatttgtattctttatctccgatagttaagtaagccatttataaaacctccgattatttttgtatgttaaaaaagagcccgggaagcccggaccctatgattccttttctgttcgtatcgtaaaattggccgaacgttccgattccccggccgagttcactgccgacacgttaaaaatgtaggcggtgtccggctttaggttaggattcgacgtgtacgaattctttgagacagtcgctatttttgcataaaacctgtaaatattgtaagatgtcgcccctttcaccgcatcccatgaaaaactcacctgatttgaagtggcgcttttcgcagttatattgcggggaacgttagggcgtaaccgcttgtgtttgcgtaacaatctcagtcattgaggactcacccgcatcgttcacagcagagacgttgaccgtgagtttcgtatcggccgcaattcctgtcaaggtgtgggatgtgccagtgacagttgcgtccagctgcttgctcgctcccctgtataccttatatgaagttgccccatctaccgcatcccatttcacggtcacgctgtcagctgtagccgtgaacgatagattttggggcgccttagggcgtagttgtttttttggcattctcgccaaactgcatgaactctttggcaccggcagaagatctgatctcgtcaattaattcttgaggcagaggatcaagttcacctttacgggtcttaccgagaacaggcaatgttgttgaaacctcaataaacccatcttgcggtgcacttttttctaagttctcgatgattgcatgtccatattcagaatcatgcttatcgtttttgtttttattcaggtttactttccatacctgaactgtctcttcgttgtcataagcatcttcaatcgccgtttgacccggatcagagacagcagcataatatgtcagttcgatgctctcagatttagggccgtacccaacaattcggccagactttgttgattcatcttttgtatcttgttctttcgtatgactgccttctgtttggaatgcgataaacagaccttcagtcgaagtagcattcatcggttgaacaaagtaaacctcatcaataccattcaataaatctgccattttgttcatcctctcaattgtttattgtgaagcgcattctgagaatgccgtgacgcgtgtaaccgtcaatatcggtgatcacctgcatgctgcgcatctcagaacggcataaagaaaagccctctattgttaggggcctgcttgttaacgcttgaagcatgaggctcagaatctccattgcttctttttttccgttgtaacctgaccagcagtgtaaaaccacattgatttcttcaccgctggatgtcttggttttaaatggggatacatcatcatcgcccattgtcacataaggcttttgctgatctttcgggactgcatcaaagacgcccgtgacacgcccgttcagctcttcgtctgttgataacctcttaaatagagcagcctgcaacggccacagggcagatcgcatgatgacagctcctttctatcacatttgactggcaaaataccgcatgccttcgtccaccgctggattccagaacggctgtgcccgcattccccgcgtgaccacccatctattaagcttggtgtcataataaacccatggcgtttgccggccgccgccttcctctgcgtaaatccctgtcccgtattccacatatacggcataatcggcaccaacagaaataacggcccgtaagccgccctcttggtagtcgatttcaattgaacttttcaggttccccccgtctattgcagcggtcggagcattcagaacagcatgggtgtaaatcagctcggccgtgtctgtgaccagttgcttaatatcgtctatgacccggtttctgaactcgctcgtggctctttgcatctgcctgacccatctaccactgacctcagccattgcccttcagcacccccgttacctgacatttcaaattcataatctcatgcatgccgccctggtcgatcggatctgatttgagagtcagcaccttgttttcgtagatgatccgcattgtcttcacaatatccttgcgatacgggaaatatacattgcaatcaaccgggttctgaagctgctgagcctgataatattcccgggacgtaatcccacccacaaaagcctctgttgtgagataatcggtgaatttttcaacatagcccccgccgccgtccggcacctcttccaaccgttgaaacgttatgacgtgcgggaattcttcatagatcatatgactctcagctttctgtatggagcaagaagcttcgtaatgctgcttggcagatctgtttcataagaatatgagacatctcccatacttcggccggaaagattggacggagtcatgttatgctcgatcgctttcgcgacatacagctttacccctgctggtaatttctcatctccattgaccatgaatgagttgttgcaccagtctttcgcttgatctatgaacagaggtaggacctcggccagataggtatcgtggctgtctgtttttataccaagcatattttttacggtttgaacatccatagaatcacctacacttcaccgagaacaattttgatcagttcctctttaggcgctttgggatcaaattcatattcgttctccttcagaaaggcaacgatttcatccttattcacctttttcaattgctcttcagtcatatcaagaaggtttgtacccggctgttcgttcggctctttagactgtttagcctcttccactctcttaaaaccaatgtgagaataaaccacctcaaaagccttttcagtgcattcaatggttttggaaccgttagatgctttcatatcacgcgccgcctccttccagtgcttttatccgattctctaaatcagaaagctttgctgtcacatcgtcaccgagtttggctaaagtaactgccttggcaccgatgttggcattttgtacactaccggtgccgatgttacgattttggacagaaccatcaccgatattgatgtttttcacttctccgtcgcctatcatttccgaagtgatagttttaggagcaggcgcagaacccgataacccggtcaccttcgcaccctcttttatttcaagctcgccgccgatcaccaatttgtcgccgttattagtgttatagtttttagatgtgtatcccataagcttacgcctccgttgctggtgtaatagcagcaaaagcatcatcggtcaatgtcatgaatccgacttgctgagtcacgcggagagcaaccatatctctctcatacaagttgatcgggtttccgtctgcatcaacaatcgttgtcaatgttgcatcctctgagattttgtattccatgccttgagggattccgtaacgtgtgtaattccagtcagccgcaagtaatgccgctttttcgtaatcccatgacttagaatccacatatccgatcggaaggccaagagcttgttgtgtggcgccgcctgttgcatcgttgaagatcggaagaccattaccatcctttgtgccgcggagcttttgacggaatcggcgtgttgttgtaaagccgtttacatctttgtcagcgtcttcaacaagagccatgaccccatttaactcatcatatagattgccaagtgagtttaacgcaattgtgttaccagattccttgattttttcaaatacagatacgccttttccaaacggtgaatctacaccgaataacgcagcctgatcaaatttgatcgcaaaggcttcagcgatagccgggcgcatttgtgtgaagaaatctgttacagagtagcgcaagaattctttagaaacagggatgatgacacccaatttctttgaaatcatttttgctgttaaccattgggccttagacgtttgaattctatctccttctccaacccagtatgcccctggcccagaagccaagtacgtgaattctttctccggcttagtcatttcttcatattttgcgagtttcgtgacagcagattgggtcataaactcttttaaaaccagcgttccttgctcagttggaaccttcccgtttactgcgtcttgcattaatgcattgttcggattaaatgttggcattaaagatagccctccttattttctaatacttgcttcagctgcaagcgagctgatgtctaaatcttgatttgtcgattcattgctgcctgactggacaccacggccattctcttgaaacttggattcaatagccttttgaagtgcagcgttgtacttctcttcgaatgctccgaggttcttcatcgttgattcttcatcctcaccgacaaagaatcccactacatctacatctgccggcagttgcttttcggaagcataagaaacagctttgtttaaaagcttttcgcgttgtgcagctgtcttttgatctttcaactccttttccagcttcctgatccgcttctgctcttctgtttcttccggataaagctcttttacctttgcatcaaccagagcatcgaggttgttcgccttccacgtatcaaggccttttgtaaaatgagaatccaaccgaggctgaatgagacgttttccttcttctgtatctaaaaacccattcaccttgtcagctgatacggcagaaagttcattcagatacgacttaacatcttcgttctctttattttcttcgagaaattttttcacatcttctaaagttggcattacgtttcttcctccttcgccctctacagtgcgcgcctgttatgagtgcatgaaaaataagccttttaatgtcatgctcaggacaaaataaaaagccgctgtttaacgtcttcccttttcctcaatggatttgtaccactcttcataggtttggtatgggattgtttggcctgccccgctgccgccttccctcgcccttctcgtatccggcaggacgccgtttactgtgaaagtaattgtacaacggcagttaatatcatccttggcattattcatgtgccctggagccggcccgacgccgccgtaaattgatttgaacagcccattgcgttctatcgtcttcccgtccagcttcctgtgccctgctcgtgttttaagatccagggtagcattccacatcttttttagattgctccgttttgaggccttctcagcgctttccatccttgccgagacttgtgccctatgagcttctgttctcgccacgtcacgagctttcctgcgggcaaattcggtcgctctttcaatgcggcgggcgatctttgaataatcctcccccgcttgtaggccctgcgcgacggaaatttgaatctgccggatataatcgtctctatgccgcctgtatatcgctgacaaagtcaattcagctatgggatttagaatggcctgccggatgacttcggctgtcgggatgctaaaacccaagttaaccacggattccatttcaaatagataagcagaacgcatataattctctaaaaactgcttggctgctaatgcctcaacaatagtcagaatggttttgaaagccttgtgagattcctcggccatcctctccatttccttgttcagacgattgtatttgttggcatcggctaaagtaagctggccgtccttactgtatttcgcatacagccgggcaatttgtgcattgatctcctttaagcgagatgcaaaaacgacatcaatcttttgagcatcctcagtgatcatgtcgtccaggtacttatcaatatcattctggttcatcttcatcaccgcccgcgtctgtttccacatccgttaacggcggcatgttgagcctgtattcctcttcttcctcttcaatcttcttcagctcatactggacatcatcaacaaacgacaacagagacaggcgggtttcttcacttaccattcctttaagctgtcccgtcgtgtttgcttcttccagtacatttgccggaaggtttctcttaaatccaaaccaaacttttctataatcttccgctgccgcttgccttttagtgtcccatgcggaaaaaatcagtttatattgataacgcagagcagccgtcatcttccgttccattgtgatgcatttgttttcaagcgacatcaatttatatttcatcgcaacccctgaaacattcccaccaaaagattcatcggagaaattgaccgatttcgcaaaacggagaatattctcttccaacctatcaagatggttttctataatggcatcgtttatatcctttgtcagatagcttacgtcgtctttttcgtcatacaattcaaggattccggtctttttgagctgatcaagcgtctcttcatccgcaccaagcccttttaaaatcagataagccagtcgatattgctcaatctcattcgatgcatcggacaacgtgcggtcatacgcatcaattaacgaaagaaccttttcggcatctccctttagttccttgttattcgctaaaccgaataaggggcagccgtcaaaaagatgcaaagtttttttatcaagagtgaaggccgagctgtctttcgtactgaaataataaacatatttctgatcatagaattctgctttaatcttgccgccgtacaccgtgtagtatcgcaaagcgtaagtaggttcatggatgcttccatcagtaataaaggcgcattcccatggatcaatattttttatacgttcgtttccagaacggtcaacgtaagcgaggcgggcgccgtaaccgcaaatagaggccattttcccccactcgctgtcttcatcagcaatgttgttttccgtattgaaaccttcaatcagctgtttcacaagttttgcattacttgcttcaccgctctcatcaaactcatacgcaataggatgaccaaacagatagcccacctttgtatcaatgatttcagaatcaaacgagttgtttagcctattgtttactttgtgatcaatacgttttaatttccctgtttcaaaatcctcgtattcaatggcttctctggataagatcggaacgccctgaacctcagcctggtaccgatcataaagctttttcattctgtcatgatccggcttatgctcctgaatgatcttgtcaatcaattcaggtgttatgccggactgctcaataatttctataaactgattcatcagctcacccctttccgccttttcggtttattatgcgaatatagagcgtaccggagagcatccagcacatcgtcccattccttcacaggatcgccggtctttggattccatacatacatgaaaatttcttttttgaatagctcaaccttgtcttttacgatgaataattcgtttcgcttaagcagccgcgccacttcttcaataccggatacgatcgccttatcagcattcagggcgcgcaacttctcccgcctgaagcgctgcacatgctctggccgcgcagaatcgcagtagaaattaatgtttccgtaccgctcttttacgcctttcgctaccttcacccagtaatcaatttcctcatgtcgcttggcatgttcttcaagcaaataaaaatacccttggtcatcttgtccgattacaacaatagaacccgggtgctcatatccccagtcaacgcccgcaaaatacttcttgaaattgacgcgcctgttttccaattcctcaaggctgatatagtgaatgtccttattgaaatccttgtaaatgactccttcaggcgccacccaataaccgtgtatgtcccgatctgtaaacatgccgctcggcgtcgatgccacgatgctctccacatattccggatcgagaaaattgttatcgaacagcgagaaatgaaatgaccggatgttcagcctgccgcttttcaacatttgcccgtctttgtcgatataatccgttttgacggtgtgcatcgggttctcagggtttgtatccatcatgaccacagcgcctttgtaggagcaccgggaaatgacttcttttacaaatgagtcatgcagggcagtcgcttcattaaggaatgcgccggctgacgtgaacccccgcgcttttttccatgaatcagcattggccccgtcaaagcaatatacacggttgccgaatatctcaacggcattcgacttgtcgagcctcaattctttacccagaatcaattccatatcgttcaagacatttcgttttatggctgcctgagtagccccgccgatgatgaaggataaacccatattctgatacttactgacatgagcaaggaacgtcaaaaggagcacgaatgttttccctgccctctttgcaccgctacaaatcagaattttgggttgctctttaataaagctgtcccaaacttccttttgctttttattcagttccatcggcattcaccattttcctcaacattgcggcaatatcattttcttgggtgtttccgtcaccgccgttaacagccttcttcgtcttctcgatattcaagcgcatttgctccaatttaaggcgccgctcatcttgctcatgcgccagctggtcaaactgcttgatcagactccggagctcacccattgcccgagattgagcgttcaggaatgttgcatgacgatcccaagcgaattgtatttcaagttcttcttctacaatgtttttttcatatgttagattgccatcttcgtcctcatcttgatgataagcgtattttgcctttttaagctcttttgccgtatcatctttattctgtacaaacataatgcgttgcgcccaaataattgccgcatattgtatctgaatctgatcccatatcatattagcaggggaacgctcctgaatctcttccatgatttcaagcgtttcttccggcagatactttgagaagaacccatgtgttacagcgttttgatttcttgccggagccgccctgtggctatttcccaatccgtttttgctgccgggttgctcgcctattttcgagtgtaccctttttcctttcccaaccatgccgctgcttccacggtttaatggtgttcaccgacaccccgtacttctcggcaaggtccttgtatttcatgcctttgacgtaatccttatacgcctgaatgtacttttcagccatctacattcaccgccgcccccttctgattcgtgtttgttttgaattttaaaaggatagccacttaaggctacccttttaataacttattgcacaatgttaacagtacatgccatatcgtcgtagtcttccccaccagaatcttcaaacccaaaattgtattcgttgtttgcataatcaaacttcaaagcgctcatgatccacggtttatctccatctgggggtgagttcttgtgccacccagttacttggtaccactcttctttatgtgaattgttttcaggggtggaaaaatcattcaactttctatcataattccccctctctgccaatttcttttcgctattgtacgggtagatacaaattgcattctcaaaagccgcattacttgaaaaatgaaactccgctctttgtccacaaggaacctttacccatccaatttggcttggaattaattctttattattatctggaccgtaacccattagtaagcctcctcttttgtttgtgcgtaacacagacattattgtgatgagaagcaacactatttatacccatctccaacttccctaattaattaacaaatgatccataaaatatcattagttcatattccctctaaaccgacgccgtactcagaccgttaaccgccaatagttttcccgagatttaccggaatcggtttacaaggaacaaacaaaaaaacacaccctacagagtgtgcttcaataattttataggcatttcctttgtatttctcttttcataaaatgcctctaattctggttgcatcaatgcattctttttattgtctttcttaaaatttcttgcatttgcattagcatggacttttataaaatcaacttcttcacaaatagcatatccaataagcttacctataaaataactggcgattccctttttccttaacttttcatcgtgaacataaaggaattctaattttacaaatatctcttttactaaccggctattcactttgaaaaattccatagaaaataagaccttcttggcttcaccatcataaagacaaaactttacatctccatccttacaatggtaattcgtttctgttgtgtcagtaatatcatcatcattaaatttaaattctataacatcttttttactgaccagcgcccccggcaagccccaactaacaactcgttctctcataatctcatttttatcatccaaaaattatctcctcccaccttattatcggtt

SEQ ID NO: 143 - DNA, 14710 bp, Bacillus velezensis FL50S
aaaacagcctcaaagcctgcatccgctgggctgaatcgcttccggccgccgaattgaaaaaagcggcggaaacaatcgtatttgcgctgaaacgggaactgcccgcacatccggaagtcttgtcatccattcatgccgttaaatatccggttccgacccgtcgcctcctctcaggactgcttcaggcaatcaatcaggctccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatcaaaacaatcaccatttgtccgagagactcgtgaaaacggaaaggcagtctcaagccaaccttctcctccgagtgcgcggacagatcaaaaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaagatgatgtattaagccttttgcagaaaatcaaaaaaggattgggcacgcgtgatgaattatcattcattacagcgcttgaaaaaggcgtatctccgcagccggagaaacaagcgctgaaaacggccctccaagccgtccggacgcttcaagaagcgccccaatccgttaaacaagaggcggaaccgcttattcataaattaaacggccagctgtttattgagcagcataacccttcttttacgcagatggtgctgtcatttccgctgggagcgtccgcgtatgagaatgacatcacagttctctttaaaggacggaagaagccggacggaaaactcgatccgtcacattgcaggctcctgtttttgctgcatcttgaaacactgcaagaaaccgttgtggactgcatgattcagcaaaatgtaatgaccattacggttgagactgattttgagcttcaggcggccatcgaccctctcgtaccggctttaaaagaagccgtaaaagaaacgggcttcagcctgtcaggcgtcacgtctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagccccgaaggttgtcgcaacaggcagggggcatgtggcggaaaatattataaaagaagctgagaaggctggggtccccattcaggaagacagaacccttgtcgaattaatgcgccatttgacggttgacgatcacataccggaggcgctctatgaaaccgttgccgaaattttttcatttgtttacagactggacgaaaccctgaaaaacgaaaaataaggaccattcatttctcggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggccttcagggctatcaggcaagggaaattgcattcgcaattaacatcccgaaagagcttgtcggcaaagccgctaaatttatgctcggtttatataaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagtgacggaagcttttaaaatcattctttccgatcaaaacgtaaaaggaattttcgttaatattttcggaggcatcatgaagtgtgatgtcatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcacacaacgggcgctgatgcgtcagtcatttacgtgccggctccgtttgcggcggacgcaattatggaagcggttgacgcggaaattgatcttgtcatttgtatcactgagcacattccggttttggacatggtgaaagtgaagcgctttatggaaggcaagaaaacgagattaatagggccgaactgcccgggtgttattacacctgaagaatgtaagatcggcattatgccgggatacattcataaaaagggtcatgtaggcgttgtatcccgttcaggaacattgacatacgaggccgtccatcagctttcagaagccggcgtaggccagtctaccgctgtagggatcggcggcgatccggtcaacggcacgaactttattgacgtgttaaaagcgttcaatgaagatcctgaaacacatgccgtcatcatgatcggagaaatcggcggcacagctgaagaagaagcggctgagtgggtgaaagcgaacatgacgaagcctgttgtcggctttatcggcggtaaaaccgcgcctccgggaaaacgcatgggccatgcgggcgccatcatctccggaggaaaaggcacggcagaagaaaaagtcaaaacgatgaacgcctgcggaattgaagtcgcggaaaccccttctgtaatgggtgaaacgctgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttttcggatccgcatccattaactgttttatcagaggggaaaacagccccggaagcaatttttcgggaaatagagcgcaaggatccggaacttgatgaagttctgtccgattaccgccgcgaaggcattactgtcattccgatttcatcaagccgttacccaacatggcttaaagcgatttatgatccgccggctgtcttgtatgcaaaagggaacacgccgcttcttgaaaaaggcagaaaaatcgggattgtaggaacgcggaaaccgacggaagacggaataaaagcggctgggcatctttccgccgaactctcaaaaaaaggctgggtcattgtaagcgggcttgcatccggtatagacggtttgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcactttccgatgagaaaccgcataatcagcggactaagtgaaggaattgtggtcgtgcagggaaaagaaaaaagcggttcattaatcacagcttaccaggccctcgatcaaggcagagaggtatttgccgttccgggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcggccgaccccgacagagaaggggaagcgattgcatggcatctcgcacacagccttgatctggatctcagctctgactgccgggtcgtctttaatgaaataacgaaagacgccattaaagaatcatttaaacatccgcgcatgattaacatggatcttgtcgatgcgcagcaggcgcgccgcatactagacagactcgtcggatacaaaatcagcccgattctttggaaaaaagtaaaaaaaggcctcagtgcgggccgtgttcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacgaaaaaagagcgcaaacgaaatcccgctctgccgtttacaacgtcaactctgcagcaggaggctgccaggaagctgaatttcagagcgaagaaaacgatgatgatcgctcagcaattatatgaaggaattgatctcggcaaagaagggacagtcggactcatcacgtatatgagaacggactcaacgcggatttccaatacagccgttgaagaggcgtcagcttttattgatcaggcatacggaaaagagtacttagcgggaaaacggaaaccggcaaagaaaaatgaaaacgctcaagatgcccacgaagcgatccgcccgacttcggtgctcagaaaacctgccgacttaaaagcggtgcttggaagagaccagctcagactatacaagctgatttgggagcgttttgttgcaagccagatggcgcctgccgtacttgatacgatgagcgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactttactcagccgcctccgcgttacacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgttctggatcttatcatggagtttttcccggaaatcatcaacgttgaattcacggctaaaatggaaagggaccttgaccatgttgaagatggcgagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgttaaacaaatcggcgtaaaatgtcctaagtgccatgaaggaaatattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcataccgataaattcgctgaactggtatgcagcaactccctccgttcaaatacactcgccaatgcggtaggcgtattaaaagaagaaatgcgggcgcttgactcagcaatcattcaatctgctgataaatgctcggttccggcagggggagcgcttgccgttgaccgccatgaatttgcgcaaagcgtgacggatctcgtgaaaaaccatccgaacgtaacggttcttactgaggaagtaacagagattccggaaggcccgacggttatcgcgaccggaccgcttacatcagaatcgctttcacagcagctgaaagagctcacgggagaagagtatctgtatttttatgacgcagcggcgccgattgtcgaaaaagacagccttgatatggataaagtgtacttaaaatcccgttatgacaagggagaagcggcatacttaaactgcccgatgacagaggaagagtttgaccgtttctatgaagcattgacgacggctgagacggtccctttaaaagaattcgagaaagaaatcttctttgaaggctgcatgccgattgaagtcatggcgaaaagaggcaagaaaacgatgctgttcggaccgatgaaaccggtcggactggaagatccgaaaacaggcaagcgcccttatgcagtcgttcagctcagacaggatgacgcggcgggaacgctttataatattgtaggttttcagacacatttaaaatggggagatcaaaaagaagtgctgaaactgatccccggccttgaaaatgttgatatcgtcagatacggcgtcatgcacagaaacacatttatcaactcgccgagccttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaaaaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtctcagacagaagtcagccgtcagggatgcgcgatcaggccctgcttgagcttctttatgcgaccggaatgagggtcagtgagtgctgtacgctcactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacataccgcgagaaaagtgagaaagctgtttaacggaaaggttctggccggatttgcgggatctgttgcagacgctttcacactttttgaaatgtttgaggcgaagcttgaagaatacaacggcaatttaaaacgtgcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggcattttggcaatcggctccggcggaaactacgccctgtcagcaggaagagcgctgaaaacctatgccggagagaatctgtccgccaaagatattgcaaaagccgctttgaaaatcgcaggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgtcgaatcaatggtcagagacctcgttgagacatccgtgcggctcattaaagaagaaaaaatcagcgaagtgaaagaacaggctgaagaaaatgcaaacaaacgtatcgtgcggcttctcgttccgggaaagaaaaaacaagcgggtgtgaaaaatccgtttgaaatgcttttcggaggaagtcagacggcaaatgatgatgaagccgatcagcaggaagaagcaagccttgaagaaaaaagaaaacgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctgatgccaaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaatcgcaaaaaacggaggggcttcttcctcagcagatgtatcgagagaaggcgttcaaagagatatccttccgattgtcgaaggatctaccgtcgtcacgaaatacggctccgtcaaaacagatcacgtgctgtttatcgcagccggggcattccatatggccaaaccgtctgatctgattccggagctgcagggccgctttccgattcgtgtagaattgagcaagctgacggtggatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggatacggacaacatcggagcgagaaggcttcacacgatattggaacgtctcttggaagacctgtcgtttgaagcgccggacgtgacgatggaaaaagtcgccatcacgccgcaatatgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcgtttcctgtggaaaacagagacctgttccaagcgggcttaacaacgatcgtgccgatcatcggcggaggagagagactgggcacgctgattctgtcccgtctgcaggatcaatttgaagatgatgatctcattcttgctgaatacggagcaaccgttgtaggaatggagattttaagagaaaaagcggaagaaatcgaagaagaggcgcgaagcaaagcggttgttcaaatggcgatcagttctctgtcttacagtgaacttgaagcgattgagcatatctttgaagagcttgacggaaatgaaggcttgcttgtggcaagtaagattgcggaccgtgtcggcattacgcgttcagtaatcgttaacgcgctgagaaagctggaaagcgcaggcgtcattgaatccagatcattgggaatgaaggggacgtacattaaagttctgaacaacaaattccttattgaattggaaaaccttaaatctcattaagacaaaagcaggatccctgaaaatgggggtcctgctttttttatggacaataggtgaaaagttgcagtttaaagttgcttattggaagctgatctgagataatccatcttgctgtgtgaaaaaaggaggaagatacagaaattctgctattttcagtcttatattaaacaaatgcttgtagtccaaatactctaggacttaatacctacatgcaaaatagatataattgagcacttttttttagcctaacttcatagactttaagcctgttatttcttacaataagcatatggttttacaattctcgacaaggatttttaggagaaaaatatctgaaatggaggtaagtggatttggacttattttctggaactatacaaaatcttgagaatgccttggggagagcggacattaagcaaaaagtcttaactaataacatcgccaatatagatacaccgaactataaggcgaaaaaagtctctttccgaaatttgttagatcaggaaacatccaatcttgaagcggtaaaaaccgactatcggcacgttgactttacgggttcaggggacgattattctatcgtgtccagcagtgatacatcgtaccagcaaaacggaaacaatgtcgatatcgacaaagaaatgacagatttagccgaaaatcaaattaattatcaggctttggttgaaagaatgagcggcaaattcaattctctgaaaaccgtcttgacaggaggaaaataatgagtggctttcaaagcttaaatatttcgggctccgctttaactgcacagcgtgtccggatggacgtcgtatcgtccaacctggccaatatggatacaacgagagcgaagcaggtaaatggcgaatgggtgccttacagaagaaagctggtatctctccaatccggaggcgaatcattttcgtcccttttacattccaagatgaacggaacaggaagcgcgggaaatggcgtaaaggtatctggcgttacggaagacccgtccgcttttaatctcgtttatgatccggagaatcctgatgcgaataaagacggatatgtacaaaaaccaaatgtggacccattaaaagaaatggtggatcttgtcagcagcacgagatcatatgaagcaaacgtaactgcattaaacgcctccaaaggcatgcttttgaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaagcttttcggagcttttaaaaaactctattgattcgttaaatgagtcacaagtaaaatctgaccaaataacgaacgaactggctgcaggaaaggatgtaaaccttgacgaggtcatgatcgctgcccaaaaagcaaatatctctctgacggccgctaccgaattccgcaataaagccgtggaagcctatcaggaaatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcattaaggttcctgagagccaagtggattcgcttaaagtccagcttgccgcggaaggcctgccgaaaacgggatcaattgattattcgtttttcggacaaaatgcgggcttcggcctgacagataatgagtttgacgttttaaaggttgaggcgactcagaccgaattgtcaaacctgataaatgaaatggacggtattaaaagctcgaaggtcatgatcaatatgcctaaagaagccgtgttcgtcggtgaagatcagccggcagcgtccgcatccatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcatctcagcaaggtattaagtcgcaggtcgaaaaggacattcaaaaacatgttcagtcactgctcggcacaatgatggggcaggataaggtcgttgtttccgtaacggcggatattgacttcacgaaggaaaaacgcactgaagacactgtcgaacctgtcgataaagataacatggaaggcatagcggtaagcgccgaaaaagtcgcggaaa

SEQ ID NO: 144 - DNA, 14563 bp, Bacillus velezensis FL50S
tcaaaacaaactcatttgatgccattcattcggttcaggcacttcactctgaccggcatcagttatccggaatagtttcttttgataggctccgcaatgggcgtttacattgttaaattttgatacgtagaaatgactttctcctaaaggaaagaggaaatactcttttcctttttcaagcggtgtaatgtctgcgctgagacattctcccttcatgaccataaaaatccctccaaaaaaggagggggttcccctccgtgttacggcaaaaagccataatcgtaatttagctttgtgtgcttgctattggctgtctgtatgatggtctttccatattccggtgtatctacaagataggctgacccgcttgagccatccaagatgatcagcttcgttttttggtcttccattaagtccttaacggaaagttgatgtagattttcaattttttcaggtctgttcatattgcagcactccccgtgttataattaattgtcgagattaactaaaaccggggccttgtgctacggttttttatgttatacgggcacggcgtttgtatttcagttcagacaattcccgaaaccattcttcatctcccataatcaaggaaaaatcaatcattgtatcaaggtcttcggcatgcagcgtgtcatccatcttctccactacccggattgaagcttttattttttctccatctacaaggcggataataactgcttttcccagcatctcctctacatatccctttacgacgatcccgttaccttttgcgctcacccaatcgcctttaaatatttcgatcatcatcttctctcactttcttttgaataccaagaacgacatagccgggcttttgttcaaagtcagtaatgtatgtcacatgtacgtcaattgagcggccagtgtatccatcctgccattcattcagggaaagggtatccccttccttaaaccctctatcatcgtgcctaatttcaaaggtttttcggccatccttcagcgctataaaatattccggtaagattttcagatgatgtcttacgctcatatatcatcaccgtcctcattatcttcttcttcccaagccatcttgaaagcagtttctaaaaaccatagttgtttttctaattgctcatctgtcatcgcggaaagatcaggaccatggccaggaaccatgcggaaatcactcaatttttctaagagcttttttctcttctctgtcatcttcttaccctccatccattccggatccggctcaccagctcgtatttctttaaaggttcatagaggtggacagcttgtccatcctctatgcgaaacagcagataccaacgcggctgctttttccttctccccatttatgccgctccgtgttcgtcctcgtccttattctcatcctctttttcatcctcggttgacggctcggggttatcagcttcatcaagaggaacacgcggcgcctgcttttccatcggctctgcctccgcttcctgatcctgcttccagtcccaccaggcttgagcatacggtgcaacttcttttctgtactcgttgatgaggtctataaggttctcttcatacattacataatcatttgcaatcctctggtatgattcaccctctatgcgccgcttggccatttcagtaatgtatacagggaatccatcgaggatcggggccatgtcttcagtaatgaaggagtcaacaatcttcctctcgatttcctttggcttttcttcgattttcggcttttcttcagggagtccaagattcgcctcaagttgttctggttccggatccgctaccttgacaattccatcagagccaaccgtgtaattgataatcgggcgatcggtgtgcgcgttgacttgtacattaaactgtacaacctcgctctccagctgcgcctgaacgtccttgtcaatcatctcggctaaattttgaatgccgcttcccacctctttagttgggacctccagaacgacctcggtaattcctttgggtttgtggttcaccttttttacgattcctttgaagtcaacgaaagacataattgttcctcctcttgtgatagtggttttactagaatttcaattcttgggttttggctgtaatacttactgacatggaggtctacaatttgactgtcatcatgccagaggactttatttaaaccgtctttaatgccctttatataattgtccacatcaggctttttgctgggtcttagtaatccttgttcagcttcagccgcttttttcttactgaaactcttcaaggtagatttatagaccttgactcttaactcaagcgggcccgtcagcaaggaacttggccgatgatctgaggcggcgagtttaacatattgcttaaaatcccttgatttctttgggtcatataacctggtcatgccgttaattgtggttgccctggggcgcccctgcgcaactggctccccgtaaatagtaaattggatcatgctgttacctcccgtcatcctgaatccactgctgtatgatcatttcctgctgttcgccttcctttaccgcgtaaatgagtgccaggacggtgtacatcagcaggattcctcctcttcggatagctttcggccaaactggcattttacttgaattgtgaggttctccagattgaatagcgtcaaatggctcaagtccgctcctttttcaatggaatagccataccgaatcaattcattgattagaaattctctccgcttctccacttcattatttggcataaaaccgctcctttttaacccacaagggcttccatttgtctatcaaggtttaagaatcgtccgtactctttaataaaggcagctatgacagtgccgacggatccgtttctttgttttgcaaaaatgatttccactacgtttttcagatcgctttgtttatcgtaatagtcatccctatagagaaaactaacgatatcggcgtcctgctcaatgcttcctgaatctcgaaggtcagacatcatcggccgcttatcttgccgctgctcaactccgcgagaaagctgagaaagaagaatgattggcacattgaaggtccgggctatgttcttcaattcgcccgttatgcttgcgacctctaagtttttcgtttcaaatttgccgataggtcggattaattgaagatagtcaatcacaaccaaatgctttttgtccgggtggtcctttttggtcttccgaatggcagaacgaatatcagccactgactgtgacggcttatcatgaatattaatgtctaatttttcatattcaccgatggcccgattcgcattttcatagtctttttcactgaaatacttgtgcggatttctccattttgtaccttcgattgaacccaaattgctgagcatccggtttacgagttgacggtcgggcatctccaatgaaaaaacatcgacaaccccacccgtaagggcagccttgagacccaagtttaaagcgaaagcagtcttccccatggaaggccgggcggcaatgattattaaatcgctgtcctgccaaccgccggtcattgcatctaaatcggccaaaccggtttccactcctgttatttcacctttctcttggtacatgtcgttgtaaatctcggttaaaacatccatctttgttcgtttatttgtaacaccgatctcctgcagctccacggtcttctgataaacctgcaaaatcccctcatcgcttggattattcgcaaaatcaagagcggtcttttgcatatcacgtagtttaaaagcttcgtagattaatgtttgataggtctcgaagttaataacagatggaacagcattggctaaatcaacaagatagctggtgccgccgatcgcttcgacggtttctcccaactctgtaactactgtgaccatttcaacaggctggccggaagcatctacatttcgcatagccttaaatatccgtttatgccgctcgtctgcgaagtgtttcggatccaaggtggtttccttaatcaattcattttcaacaaggatacagcccaataggctctcttctgcttcaaggttttttagcatgttttgcattccgttcccactctttctgttgctctaaaaactcgtttttcgctggttgtttgactttaatttctgagatagtcggaggaaatggcttattagcaatatgctcattgactttgtcataaacaggtttgtatggcatttcagtcagatgctccatccataatccgatccgctccatacccacatcacctgttaaatcaaagcgggtatacgcggcggagagtcgccttagaattttcattgcttcttcttttttcaatttgatcaccccatcgaaatgccgttttctttggcatatgcttcaagtgcggcaaaactctcctcttgttttgatccgcgcggccggaactccgaaacgtttgtttttggaggtggattctgtttagcgtgccacctgtctaaaataccttgctcacagtaagtaaaggatttgataccgtctgctcgatgcttaggaacgtaacgatcaaatatttcatctatccaagccaggacatcctcaattggaattttttgatcaaggattctgtttatggcagccacatcatatggtgttgtaaacatgccgccctttcgggacaggtacttttcctcgattttttggaaaggagtcagtttttcatcacttggttgggatatttgccgcctttctgaaaagctctcttcatttacgattctttcagagccttgaaatttcgaatagttcacaatggtccagagcattccgtattccgtttcctctgcagcaatcatgccttttgcttgaagcctttcagctgcagccttaattgccgctcttgtaaatctggttaaccctcgtcccttttttactgctaaatcatcacatagttttgaatacgagcggatatattgtcctttcttcaattcataatcatttattttcataccgtcctgataagctgctttagccattaagaaagtaaatagcctaaagcccacattatctgtaaagatctcatgatcgacgactgacttgtataatttcacccagcctgacaagagccttcctcctctccaaagagtttattttcttctacaaagagcgtaagtgcctttaatagccacatattcaaggctcggctcatacttgctcataaatgtcttaatataattctcaagcaccgcttttctcatatgcggagcggaagtctgtgccaaaaacacataacaataaggatacgtagtttttatcagttcactcacgggatatagacaacctttcctgtcaatttcatgatgtcttctttaaagatcttttcgtcgctgtttgattctgaaagatgaagcagccatatctcctgtactttgcttaaatcattggccattaaaaatttcttgacgttttctaaactaaaatgagattgtaaaagccgctttttcatggcgggagcggtaatgccgctctcaatattttcattcaatatcttctctgagtaattgcattccaccatgacatgagtgagaccagggaacctatagcgtatataataggtatcagtggcgaaaagcagtttatccccggcgtcattcgccaataggaagccatacggctccgctacatcgtgttgcacgtcaaagggcataatagaccaggaaccaaccttaaacggctgttttacgggcacaggcttaattctgttatgagtgaggccaattgctccggccgtcccaggagacatataacaatcaatgccggcgttcagaacatccttaatagccttgcagtggtccccatgttcatgagagacaaggcagccagcgaattgagacattctaaactgaaagcccttttgcatttgtttaaagctgataccacattccaacagaagcggggtcttaccatcggtaacccgatagcaattccccttactgctcgatgacagggctgtaatttcaatcaaaagtctggtccgttcccttcaaagactgaaggcttctcatctttttttgttggttgcggctccggctgttctgtttgtggatccggaattggttcgatatcgataacctctgtattcgcgttttcatttacctcacggcgcacccgttcttcagcaggtatatcatcgttagcctgctcctcttcctctgtgtatagatttcctaaactattagggaaggcttcacgcagggcatttactattgctgtttttcgaatcatatttaagggcattgtcttccaagtggattgtcctttgctgaattcatccaggcttatacgcacgcaaattggttgctgcctatccgcacggtaaacgtcagcccaccctccaattagattatcttttggaagtttgattgcgccctctagttcaaccatatccccttcacgttcaacgataattccagctttaaacccctgaaattgctcgttattctctgcacgcttcataaatgcttctttaccgacaatcatttgagccggtgagcctttaaatttcacaaggtacgcctcatttaaaaacggattaagtttttgatacttacaaaggtttataaacattgctgcttcttgatcagttacgtcagagtttccgcgaactaaaaagtttttaactgtttttcccgtgagctttacagattcaccatttactgaaaactcaacttgttttgtcattaattctgtggtttcactcatttgaatcctcctcatcctcgtacacaaatttcaccttttttcccttatgctcaattagaaagtttttaagcagctcagcgaagtcggagggtccgactaaatctctttctaaaatcgcatcttctggacattcagaaagcggacccacatgcataatctcttccgaatttatacgcaaggtttcacggcgtagatcttcccaacctttccccgtaactactgttactgtgacaatttcactcatgcacttacctcacaatccactggaatgagcgaactatcttccaattcaatccgcagctgcttgtctttttcagagacaatcagactgagaatctgtgaatttgtgtcgatcaatttagtcactgcttcagagttatctacgaagattggagcagaaatgccgtaatgctcattaagggtattaatgatgtccagtccaacatttatgcgggcggcgttgtttaagccggaagagtacggaatgccctcatatagcgtttcacacgtctcttcaagacctccattgatctgactcttaaaaagcttgaagcgggcaaatttgaatttgttgtttatttgttcttccaggagatctacctttgtacgaacaaattcctcagtcaaatagagttgatgctgaagcccttcatactcctcggctaagcccttctgttcctcttcaagctgcatgatccgcttgttcacttttttagaatgcgaaattttcgccaaatctttttgaagcagcagcatctcctgttttttgccgttaatatcatctttgatcaattgaattgcttcgttctttgatgactccaattgctcaatctgtttacggatgctatcaatctctgattgtttgtttttgtaagcaacatccgtggtgatatctgacatgttgctctcggccgccttgatttcagtatcaagttgtgaccattcctcacttttgctctcataatccttctgcagtttttgagccactgactctatttctgcgattatgccttctgatctccttagctcttcgctacgcgatttaccccgctcattgattttttctaattcactgcttttgtgagaattgaaattctctttcgcttgctcaacctgttccggcggtaatgcctggccgcatgtagggcattcagtttgatgctgatcaaacgtttcctcattcttatcaagccaactctggcgcagcgactggatttccgcagttaatctttcctggttgtctttttcaagcgacagctgacgggtattcgatttaatctccagagaaatttcctccagcttattttttaccgagaacagtttttctttcagtgccctgatattgctgtattctttctcctgatgagcgtttttcatttcctgaagctcgttctctatatgcaggatggcatttctcttttccgataccgcctctccgtttcgagcggattgcagctgatcctccaacaaatcgatgtcattttgaagacaattgatttcgtcgtttaattcctgttcatttaggtcagttatatcctcgatcgaccggagggcttcatcaatcctgacaggaatcgccttcaactctttatttatctccgcttgtttggccgcgattacttttctgtgatcctcaattgatcgtttgtttaagatactctctaaagcctttacggatggattcgcttgaaaaacttcttcttgcgtaatgtcaccgcaaatttcaagaagaatctttcgtctgtcctgccatttcatttgttcattgaaaaatgatggagaagtgacaaggcggaaaatatcttccgaaatgattccatttacacgatcattgaactcttttttctttgccggcacaccatcgataaaataatctgtggtatggccagaaaatacagcctgactgctgccgcgctttctcgtccatttctcggaataaacttttttaagagtgagatgactaccgtcaataacgaaaacgcctgttacctcatgattcaatccagataccggttcattttcttttgtcagtgttttaatttgaaaatcctttttgttttgactgtctttgtcaaacagcagccaaataaaggcatcaaataaagttgttttaccggtggcattatctccgtacaccttgacattctcacctcgagtatcaagggtgaattgcttaacgcccttgaaattcagcagctccaacttcaatagcttcatttcctttttcatttgcccccacgtccttccgctctttgtttaagagcgagatattcctcacgagcagcggcagtaggaaaacgaaaagccacattgcctttaatatcaaaagagatagatccgccggcagatgccaggttgacctgatcgcgataattctcgctaaatggttcagtgtaaaaaacttcattcatttgtcaaagacctccaatatttgatttttggaaggtgataaagtaaacttgttagtaccaaagattgcaacaccttccgaagctcactctggacagtgagcttttttaatgcttaaaatttgtgttttgccaatgatgctgaaatatcatcagatattttgttcaatgtattctgcagaacgttaacatctttactctctgccaatagagatgccattgtcttcacaattgacatatcagcccggagctcaccgataatttttgttgccgcaaccaagtcctccacagcgtcaaacgtattacccaatttactcacactccttcctgatgcttgcgcccatcgtcagaccaaagaaagagacaatgtgaagggcgttggggggataagcgcctctccccctggcctgacgacaagaacaaacttgccgtgctctcaaaagagcggtataatagatacgaacatttgttttatgcagtgagcgtgccggcttgctgcttttttattttctcgatgtcttcttttgcttgggcatttgccataagaataagagccggatttctctttacttcccgacaatgtttaacaacctcagaagctttcatcaaacggcttgcagataatacaaatgacatttaaatcaatcctttcatttttttaatgattccggatactggacagatactatctttgatgatgccttcaatttctccactcgttcggcagtctgatatcgtttgatctgaatcaacgagcgcaacacatctttatgtgcctcaacagctttagctgtgtctcctgtttttaatgcttccatgattcttgtatgcaatgtttcaatgcagatcatttccagtgttattccactatgatgaatgcccgcatagactggcttttccatttcgtttttcatttcaacctccaaatagagtcatgatgttttggatgctttgagcgactgcgctcggatcaatgccgcataacgttgcaatcattgcctcctttgcatttgtcgcttccatccatcgtacgtatgtaggaacatctaaagattttttgtcgttctcaaattttgatatacagctgcgggatcggtgtagtaattcagctagatgttcttgtgaaagacccgcccgctcccgcgtacttcgaagtagtgcccctaatttcaacttgttcaccccccctcaatgttccaaatcggaacatgttctgaaacagaacagatttgtgtcggagcatgttgtactcttaggtggaagaaatctacatttcaatagaaagcacgctgttttcttcctgttcttttatccatgcattgagtgaatcaaccctaaagaaaatcttcctccccaccctaaaatgaggaatttggttgtttcttaccatgctataaatggtttctttatgaacccccaaaaaagcagctgtttcttgagggcttaatgctgttcgttgcaaaatttcacacctcaccattaatcattatttttagggattaacggttcatttctcattacgaaatcccttaagcactacttgtttctaaatcagaaacgttttccgcaaaaaaatctgttattttgcattgtaaatggtgtgctaagatcggcaattgttcagctttaaaagcgtataggccttgctcatatttcaaataacttgagccagttttgaaacctaattttgtcgccatatattgcagagagatttttaattcttttcgtctattcttgatgaaaattaaattaagctgctgcatttcttcactcctttcgtttctgtttcagaaacactgtaatcacataatacatttctaaaacagaaatgtcaacgatttttgtttacaatttagaaactttttttgtttccatatcggaaacgtgatatcatttgtcttacttggaaagtggtgaaaacattgaatataggtgatcggatcgttttattaagagaaagaaaaggctggtcccaaagggagttggctcgccgtgtaaacctaaattatgctgttatgaaccgtatagaaaaaggtactcgccctattactgattcagaaattattagtttatctaaagtattggatgtctctacagactaccttctaaaaggtgactcccatgactcaaagatagatgaactcttaaatgaccctgaaactttaattgctggccgtgacggaaaaatcaccaaggaacaagcgaaagagcttttagagtatcttctcaaaaaagggttcgatgaatagcagacaatcattctccacttcttaattcttaacttcttaattcttcttttggtaaaacatttgtttagcatttgtttaacaaaaagaaaattaagtgttaaattaaaaattttcatccccatgaaaacatagaattaccaaggttttgcggtaagcgtgtactgtaaaataaactgttcacgaataagtaaattgattgagatataaagaaaatcaaaagggggacaaaaaattgtttaagaggttggggactttactattgattgcttcgctcgtgttactcacagcctgcaaaaatagtgaagagtcttcttcttcatcttccgggaacaaaaacagtgttcctgataatagcccgtcggagagtcaggatatttccgaaaacgggcccaacgaagttggagatgtatatgaaattgatggtggaacagcaaaagtaacggccataagcaataaagaaaccacagctaaatctggccctatgcaacttactgtgaaaagagtaattgcagcggtggctaatgagaaaacgccttttattgaacttgaactggaagcgaagaatacatctgatggagtagtgaatttcactccagatagtataaaacttgctacaagcaccggagtacaagttgaggaaccttctcttgatgaaagtgacgaccttctcggagagtatattgggaaagtaaaagacagtggatctgttttttatatctttcaaaatgaagaggatatagaaaatctagattcaattcgtctaagggttgcatctccaagcgatgagaatgctacagcattaggggataagatggatataaagattaacttagagcattaaaatgagcctgctttttcaggcttttcttttaaacaataaaaccgaacataggtttgtagttactgcaggaggatttattttgtttcaattatcattacttgaagaaagaattagatctatttattccggtataggaattactgagccaggagctggagacttagaaaaaatcgcagaacgattaaagatattaatttactacaaaaatgaaaagagtgtagctgtgaaattactggggatggcttgtattatccttgattcacgtatgtctaaaaagaagcaatgggaagatttttgccatgaactctgccatcacattaatcatgtcggtgttcaatacaagatcccttccctatttagagagctgcaggagaatcaggcaaatgcttttatgtatcacttcgcagttcccacttttatgttgaagaatctcgttctaccggccaccaaacgagaggcaataacctacatatccaacttatttcaagttacgtatccattcgcagagacacgcctggatatgtatctccgcaaactattcagttttaaatatcatgctttcttaactcaaagattagaaaaggagaagtttgtctatgccgagtattgagaaaagaggagaaaaatcgtaccgtctcattgtggaggtagggactaaaggaaaaagaaaaaaagaaaaaaagtccattaggattgaagatgaaaaattattaaaatcaccaaaaaaacttaggacttttttagaaagtgaatggtataaattcaaggctgaaattgaagccggcacttatataaagccccaaaagagaacattcaatatgtttgtagatgactgggaaaacaaatatgcaatgagtcacctagacgggaaaacaattgaaacctataactatataatgagtaaagaaattaggccatggtttggtgatatgcatttagaagatattcagccaatccatattctgaattttttagatgactacaaaaagagtaatgaaaatatctcatcttcaagtattcatgcccggtatcgaattataagagacatattgggaagagctgctgagtggaagataattggtgaaaatccggctttaaatgttaagcggccaaaacaagaatataaagaatatgaaatatatacagaagaagaaatcaatcatatttttcatctacttgatgaatatgctcctctgagaaatcgggtatttatcaaatttgcaattactggagggtttcgcagaggcgagttattagccatagatgaatctgacctattctttgacacgaatcaggttagaattgatgagtcattgcaatatacaaagaaacacggatatagatttaaggccccaaaaaataagtcatctaggacgattacattgccggcctctgttatgcaggaagcttatattttattaaaggagataaagaaaaacagacttctattaggtgagttgtgggttggatggaaagaagacaaaaataaactcatgttgtttggagcggataacgggaagccacagtatcccacatctccaaatacctggtggcagaaattcactaaaagacataacataaagccgggacggctgcatgacttgcggcatacacatgcaaccatgttagttaaccagcttggtacagtacctggtttaaatataaaagatatctctgagagacttggtcattcaaatatacaaacaactttaaacacatatactcacagtaatagacaggcagacgcattggtggcagatgcgatcggaaatatgatttactcagaaaatataaaaactgggacaagttaaaaggccgatttgataatccgtcccccactcgtccccagcctaaaaatataaaaactaggacaagataataggtgcgatttgataattcgtccccaattcgtccccaacctaattttagacaaaaaaataacagttccataacgcgcggaaactgcttcagatcaacgtatttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataaca

SEQ ID NO: 145 - DNA, 12782 bp, Bacillus velezensis FL50S
gctcggaatcacggacgacaatgagctgaaagcgggtcttgcgctccatatcaagccggcgattaaccgaaaccggtacggaatgaacctgagaaacccgatgctctccgccataaaggagaattatccgctcgcatttgaagcgggagtgattgcgggaatcgtgatcaaggagcaaaccggcattgatattcatgaaaatgagatcgggtatttggcgcttcatttcggagccgccattgaaaggagaaagacggaacggccgcctaaacgctgtctgattgtctgtgcgtccggcgccggcagcgcgcagcttttaagagaaaagctccgttcccggttcgcaaaacgtcttgaaatcgtcggaacggctgattactgcagccttgaccagctttcctttgagtcgattgattttgtggtcagcacagtgccgatcaaaaaagacctgcccgttcccgtattgaaggttcatacgctgctgggcggcggggattttacaaaaatcgacgccatgctggaagaaaatcgggaacaattgaactttctgaaaccggagctggtatttttgcagcaggatctggagacgaaggaggacgtcatccgttttctcggacagcaggttgcagaaaccggcctcgcttctgattctctgaccgattctatttttgaaagggaagcgatttctcctacgagtttcggcaatcttacggcgattccgcacccgctcgttccgcagacagacacgacgttttgggcggtatgcacgctgaagaagccgattgactgggcggataagcgtgtccaatttgtctgtctgctctgcgtcgagaaagaaagcaaagccgacctccagcatatgtacaaatggctcggcgggatgttggatgatccggccgcggtaagccgtctcttaaaatgcacaacctatcaggaggttttacgagtattcagagacaaacgatcagcaccttttttccgttagcagcggaaaaagcctgagtagttatgaaagcgatttcataatatgatggtactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttggacctcaagtccgttatttgcttccgcagctgaaaaaattgggtgaatcaaaaggagtgccggttgaagtcatcaataccgtccattacggcacttgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcattgcgtgacggaatcatcctcaccatgccgcttatcatcatcggttcgttttttctgatcatcggcaacctgccgattccgggatatgcggatttcatggcaaatacgttcggaagctcctggtctcaaaaactgcaatatccggttgatgcgacctttgaaatcatgggccttgtcgctgctttcggaatcgcctaccgcctggcggaaaaatatggggtggacgctttatcggccggtgcgatatctttggcagcgtttctcttggcaacgccgtacaaagttccgtttctgccttccggcgccaaagaggaaatcatggtgggcggcggcatcccgctgtctctcatgggaagcaaagggctgtttgtcgcgatgatcatcgccatgctgtcgacggaaatttaccgcctgatcatccagcggaatttcgtcttcaaaatgccggacggcgtgcctcccgcggtcagcaaatcatttgtcgctttaattcccggctttgccgtcatctttctgatctggggtgcgcgtttaattgttgaagcgacgccgtttgaaagccttcataacattgtaagcgttgtactggggacgccgctctcgattcttgggggaagtctcggcggaagcctggtagccgaagcggttcaaatgctcttgtgggcgtgcggattacacggggcgaacattgtcggcggcgtcatggcgccgatctggttcggagcgatggatgccaaccggattgcgtttcaggcgggcgatgcgctgccgaatattttcacccagcagttctttgaaatctggatcaacatcggcggaagcggcgcgacactggcgctcgtggtcaccatgtttctccgttcgcgaagcaagcagatgaagcagcttgggaaactcgccatcgggccggctgtctttaatattaatgagccgattattttcggaatgccgatcgtcatgaacccgatgcttctcattccgttcattatcacaccgcttgtcacactggtctttacctatatcggcatgagcactggcctcgtcgccaaacctgccggcattgccgtcccatggacgatgccgccgattttctccggctatcttgccacgggcggaaaaatatcaggggctgtcatgcaggcgattaatatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggaagaagcgcatcaatggaagccattgccgccgcaaagcggggggacagagccatggccgaggaaaagcttcaggaagccgcaagggaactgaccgaagcccatcattaccagacagaattgatccaaaatgaagccggcggagaaaaaacagacatgacgcttttaatggtgcatgcgcaggatcatttaatgaatgccatgaccgtgaaagacttggccgctgagttagtcgagatttacgaaaaagtgagtctgcaagggggagcaaaaatatgacaaaaggaattaaaattgtaacgatcggcggaggttcaagctatacaccggagcttgtggaaggcatcattaagcgctatgaggaactgcctgtcagagaattatggctcgtcgacattcccgaaggcgagaaaaaactcaatatcgtcggcacgcttgcaaaacgcatggtcgaaaaagcgggcgttccgatagagattcacctgacgcttgaccggagagaagctttgaaggatgctgatttcgtaacgactcaattccgcgtcggccttcttgaggcccgcgccaaagacgaacggattccgttaaaatacggcgtaatcggccaggaaacaaacggtccgggcggtttattcaaagggctgcgcaccatcccggttattctggaaatcgcgaaagacatcgaagagctttgtccgaatgcatggcttgtgaatttcacaaaccctgccggcatggttaccgaggccttgctccgctactcgaatcttacaaaagtcgtcggtctctgcaatgtgccgatcggcattaaaatgggcgtcgcaaaagcattggatgtggatgtcagccggatcgaagtgcaatttgccgggctgaatcacatggtcttcggattagatgttttcttagacggcgtcagtgtgaaggatcaagtcattgaagccatgggagacccggaaaacgccatgacgatgaaaaatatctccggagcggaatgggagcctgaattcctgaaggcgctcgatctgattccttgcggctaccatcgctattatttcaaaacgaaagaaatgctcgagcatgaaatagaagcgtcacagacggagggcacacgcgccgaggtcgtgcagaaggttgagaaagaactgttcgaactgtacaaagatccgaatctcgccatcaaaccgccgcagctggaaaaacggggcggagcgtactacagtgacgcggcctgcaacctgatcagctccatctataacgacaaacatgatatccagcccgtcaatacgataaacaacggcgcgatcgccagcattccgaatgactcagcggtcgaagtgaactgcgtcatgacgaaagacggtccgaaaccgatcgccgtcggtgatctgccggtgtctgtccgcggactcgtccagcaaatcaaatcatttgagcgcgtcgccgctgaagcagccgtcacgggagattatcaaacggcgcttcttgcgatgacgatcaaccctcttgtcccgtcagactccgtggcaaaggccattctggatgaaatgcttgaggcccacaaagaacatctgccccatttctttaagtcgattgaagcataagagcagtaaaaaaacccggattcgcttccgggttttttgcttattttgattcgcttagtgaggcgactttcgccgtccagccgaacacgtcggcttccgcgcctttttgaatgcctgtaatggtatcatacaatttcttcgagatctctccggtttcaccgctgccgatgacaagactttcatcattccagatcagttcgccgaccggagaaatgaccgccgccgtaccggttccgaatgtttcttccaatcggccgtcgcgatgcgcctggatgatttcatcgatcgaaatcttccgctcagacacagtcagtccccaatgtttgagaagggtgatgacggaatttctcgtaatcccttcaagaatgcttccgttcagctccggcgtcacgatttcgccgctgattttgaagaagatgttcatgctgccgacttcttcgatgtatttcttctcaatgccgtcaagccataaaacctgggaaaatcccttctcttccgcaacctgctgcgctttcaggcttgatgcgtagttgccggcggttttcgcgtttccggtgccgcctttgacggcgcgcacgaattcgttttccacggcgatttttaccggtttaatgccttctttgtaataagagccgaccggggaaaggatgataaacagcttgtacgtatgggatgccgctacaccgaggaaaggctcagtcgcaataataaacggacggatataaagggaagtgccttccgctttcggaatccagtcttggtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccatccttgatcggcgtcgtaatccataacaaacatatggtcggtgaaaattctgccgaacgcaaggttatgggggtccggtttcggttttttggctgaagtcaattcaacacgaatgtcttgtttcataatgttctgtctccctattggtgttattgtcaaacttatttgaaaataatttatattctattgtataccttcaacaaatattcgcaatagttttcctcaaatttgtgaaaaaatcaaatcacataaaaagcaggggagagaatgccccctgcgtgttcgtttttacgtattctgtcatcaccgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataaccacgaacatcggttcagcgccggcatctttcagaatgttcagcatatcctcaaagtcgtgatattcgactgatttggcgtacgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttggtttctcccattgaataataaagatcttttttctcaagcagagaataataagctttggcagccggcatgaccgctttcactttccatgattgtccgttgaccattcccttgtataattcagaaaggacggcatcatgctgaacaactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagctttttgcccttcagctgctgataatgcgccgcaaagttcacggcgtgtatcaaggattggtccccgccttttccgacaagataaggcgtaaagccttggttgttcacttggaaatagttggacgggtgaaactcatccagtcttgaaagctcggaagaaccgaaaatcggcatatacttcgagtcttcgaacattttgttttgcagatagaggccctggaacatattcggatttaaggctgctgccgactcttcgacacgtttttcaggaatgaagcgcgtaagccatgaagccggaactgcgatagctccgacaaacaggacaaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagttctacagttccgaaagaatcaagcagtccttcttcaaagatttcaatatcaggattttctttcacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtaaaggccgtatataatatattgcagggcgagtccgtgccagacgcccatcagcatgaacagcaggaaatacccgatgttcgagacggccatccggttctttatccattttttctttgtcatccagaatacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttgctgtgggtgatatgagacagattcataatgaaatacgtgttaatcgcatatccgataatgaatttgtacaagaaaccgataaaaattttatgaatgccggtatacagtaaatcagcgtattctccctttgtccatactttctgttcgtccttggcaaatctgcggtatctgtcgatcggaccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccggatgatgaggcgccggcgggaagaaaaacggccataatttagataaaaacaggggtaaaatggacgcgatcacggccatactgaagacaaagccgctgttggctttcagtctgtaagcgagataacccctgattaaaagcacctgccacagcgtaaagatacatagtgcgatcacgccgtgcagatcatgcgcgaaaatcaaagccaatacgatgatggatataaacatgttgtatccttggaatctcttgccgttcagccctaaaataatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttcttttttaatggcgcttgtcagctggaattctttttcaaaatcatgtttttcaggcacgatggcggcaattaaatattcgactggtccgttaggctgatacgggatgacaaccgccgtgcgcacatattgagactgccttacatgtacttcgatttcctccagctccatgcggtagccgtgaagcttaatctggaaatcaaggcgtccttggcagaaaatctgaccatcctgaacataaccggcatcacccgtgtgatatgcccactggccgtcaattgagaaaaacgctttttccgtcagagacggttcaccgagatagcctttgctcacgctcgggccggcgatgatgatttcccctttttctccgtccggaagcttattcccgttttcatccatgatgaagatattcatatcgggttttgcaaaaccgacgggcagagattcattttcatcgataatctgctgcgtaatttcaacggaggtgacggcaaccgttgtttcagtcgggccgtatgtattgaatacgcgggccttcggaaaacggtttaacagttcctgtgccacggcagccggaagcgcttctccgcaaaacataaatacttctgcctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcagtgcagcgtacctcccgtttgaagcgacgggaaaatgtccatgacagataaatcaaaagaaaacggagcttggtttaagaatgtcttacccccgcccacaggaaaatccctgcagatccagtcagtgaagctttgcaggttatcagccgatatctgcacgcccttcggatttcccgtgctgccggacgtgtaaataatgtaaaacgtatccagctcttttacccagttctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcccaagaaagaaacgatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcgtatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcatcatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaggcgctgttcaggcgggatttttaacttatcgtaaatttaaacgaggtaaaaaaaatttggcggctttttcttaagcaggcttgtgccgaaccccaatggagaagggcgaaaagctgtttccggcaggatagctgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagataccgaggattccgtcggtatcggcggagcgatcgtccgccacggcatgaagccgaaaacaattctgcagctggcgctcggctcttatgcgattgctctcgtgctcggtgtttatatctgcatgagcagcagctggtggcttgcggctatcggccttgccggcatgctgatcggctatctgtatacaggcggcccgctgccgattgcgtatacaccgttcggggaactgttctccggcatttgcatgggctccgtatttgtccttatttctttcttcattcagacaggcagaattaatgaacagagcattttgatttccatcccgatcgccattctggtcggagcgattaacctgtccaacaatatccgtgatattgaggaagataaaaaaggcggacgtaaaacgctggccattttgatggggcatagaggggccgttatgatactggcggcatcttttgccatcgcttacatctggatcgtcggtcttgtcatcatgggttacacaagcccgtggctgttcctggtctttttgagcgtgccgaaacccgttcaggccgtgaaaggctttgtgaaaaacgaaatgccgatgaacatgattattgcgatgaaatcaacggcgcaaaccaatacattcttcggattcctgctttcaatcggactcctgatcagttatttccgctgatcaaatgaaagggcaaatgctataaccggcatttgcttttttttatgacataatcttcacgatattgtaaagaacctgaccgcggattgacccgtctcatatatggacagcaaagcaaggagatgaaaaaaatggacttgtcaacagcccatatggatgatttgaaaacggtcatggaagattggaaaaatgaattattagtttataaattcgctttagatgagctggatacgaagttttctatcatcagccaggaatataatctgattcacgggcataacccgatcgagcatacaaaatcacgcgtgaagagttttgaaagcattgtcaataaactgatgcgcaaaggctgcgatgtgacgacgcaggaaatgaaagagcatattcatgatatcgcgggtgtcaggattatctgttcctttatttccgatatttataatgtcgctgaggttctgaagcagcataaggacttgaagatcgtaaaggtgaaggattatatcaaaaacccgaagccgaacggctaccgcagcctgcatttgattattgaaattcccgtttatttaacgaatcgtgtggaatatgtgaaggcggaaattcaaatccgcaccatcgccatggatttttgggcgagccttgaacacaaaatttattacaaattaaataacgaagtcccaaagcatctgaccgacgagctgaaggaagcggcggacatcgcccattatttagacgaaaagatgcttgggattaagaaagaagtcgattaaacgattgacccgtcacaaccagccggaccgctattatacgcagtccggctggttgtttttatgtttaggtgttttcgctttcccgcgcgatgtattctgacaatgattcaggctgaaatcctgattgaatttgaatagagaatgcaatagatatcaaatcgcaaacagcacattcccgcagaaaaaatgtgtaagattgaggtttacttttaaaaaaaagggaaagacatttgtacaacaaaaagggagatgaatatcagtgggaaagaatgaaacaatgcatatcgtatcatgtgccgatgataattatgctcgtcatttgggtgggatgttcgcttctttattgatgaatatggataaaacaaggaatgccaaattatatgtgatcgacggcggaattactgccgaaaacaaggacaagcttgaacagactgcgatgtcattcgggacgccgcttgaatttttagaagtagacgctgatcaatacaagcatgcagtcgaaagcagccatattacaaaagcggcttattaccgcatttctatccctgatttaattaaggatgagtccgtaaagcggatgatttacatcgattgc

SEQ ID NO: 146 - DNA, 12705 bp, Bacillus velezensis FL50S
ggctcggcgtgcagcgggacatgagccgcaatccgctgtttgatgtgatgtttattcttcagaatatggagcgggaggagataaatctggccggtctgaaggcgtcacgatcaaagcataccgaacatgatgtatcaagttttgacctgaccttatcagcggctgaatccgatggaaacatccgctttgagatggaattcagcaccgagctttttatgaaagaaacgattgaacgctggatgggccacttactgaatctcttgcgccatgttgccgccgaaccggaagtcacactatcgaaagctgacattttggatgaagaagaaaaacaaaagttactgattgagtttaataacacacaaaccgaattcatggaaaaacacaaactgtttcaccagctgtttgaagagaaagcagaagaaacgcctcatcagaccgctgttattgaaggagcacaacagatcagctatttccagctcaatgagcgggcaaaccgtcttgcccgaacactgcagaaaaatggattcggtccgggaaaaagagcagccatattagcaaaccgttcgattgaagcgatcgtcagtgttcttgcggtcatgaaatcaggaggggcgtatataccggttgactcccattatcctgaggaacggattcgctatttattaaaagacagcgcggcatccgtcttgatggtgcagtcagaatacaaagaacttgcttcacagctgacggatcacaatttatttctcattcagcttgatcatgaagatcaatacgatatttccgcaaagaatattcagccggcagcgtcaccggatgataccgcatatatcatatatacttcgggaacaacgggaacgccgaagggagtcgaagtcagaaatcgcagctttacgcatgcagcacttgcatggcgcaggatttatgagcttgatcttataccggtcagagtgctgcagatggcgagtttctcatttgatgtattttcaggggatctagcacgcgccctgctaaacgggggaacgcttgtcatttgtccggatgacgtccggcttgagccgcagcagctttatcggctcattgatcagcaccgtatcacgtttatggagtcgacacccgcgctgattgttccgtttatggaatatatataccgccggaaactcgcgctgcaaagcgtaaaaatactggtacttggttcagatatgatcaagtcgcaagatttttatacgcttcatgaacgctttgggaaagaaatgcggatcattaacagctacggtgtaacagaagcgacaattgactcttcgtattatgaagccgaaatgagcgaagagccgcgggaagatgatgtgccgatcggtgttccgcttccgaatgtgcaaatgtacgtcttaaacaaagacaaacaggtccagccgatcggcgttttcggagagctgtatatcggaggcgccggcgtcgccaaaggatattggggacagcctgagctgacagaggacgcattcagtgacccgttacaaacgggagaaacgctttacagaaccggagatcaggcttgctggctgccggatggaactcttcgttttaaagggcggatcgataagcaggtgaagatcagaggctacagaattgagacgggagaaatagaaagtgtgcttttgaaacacgatcaagtcaaagaagcggctgttaccgtgatgaaagatgccgaaggacaagcacgattagcggcatacgtcgttcctaaagaggccgatatctcatcactccgccagtctcttatgcaggagctcccggcttatatgatgccgtctcatattatcggtttagacagcatgccccttacactgaacggcaaacttgataaatcggcattgccggcagaagagatacattcatcacaggcatttgtcgcgcccggcgatgaaaaacaggcgatgttatgccggatttgggaagatgtgcttcatattcagaaagcgggaattcatcactctttctttgagcttgggggagattccattaaggcgcttcaagtgtcagcccgactcgccggagaaggctggaacatgtcgatccgcgatttgtttcagttcccgacgattgcagaactcgcgaagcacctcacgccggctgtttcaacggctgatcagggcccgatagaaggaagcgctccgctgacaccgatccagcagagattttttgaggagccgggtgcgtttgagcttcattataatcaatcagtcatgctgtgcagtgaagacagcctcgaaatagatgcgctgtatcaggcggtttgcgcgctgacagaacatcatgatgcgctgcgaatgactttcactgaaaatgagcatggggaagttgttcaatataaccgcggaatcacagagcagcatgaagaaatctttacgcttaacgtcatagatctttcagaagaaacacagccggaaaaacggatagccgctgaggaaaaagaaatacagcaggctatgcgccttgatcaaggccctctgcttcatctcggagtgttcaggctgaaagaagccgaccatctgctcatcacgattcatcaccttatcacggacggcgtgtcgtggagaatattgcttgaagatctgcagacagcatatcagcaggcattggacggcaaacaaatcgaactgccgccgaaaagcgattcttatataaagtatgccgaagagctttttgacatttccaagagcaaagcattgctggaggaagccacatactgggacagcgtgatgtctggtgaaacagcgccgctgccgaaaataactgatgaaaacgccggacgattgcaggaaaatgcgcgcactgcatcatggatattaagcagcgaagtcacgaagcagctgctgatggaaacacagcaggcgtacggaacggatgttcatgaattgcttttaacggcgcttggaatgacgcttcatgagtggacgggttccgaacagatccttatcagcactgaaggacacggacgccaggggcatattcctgacattgatatgtcaagaacggcgggctggtttacatctgtttacccggtgcttttggatatgagagtgccggacggctcaggggaaacaaccgcgcaccgcataaagacggtaaaagacatgatgagacgggttcctcatcacggaaccggctacgggctgctgagatattcgcgaaacattctttataaagacccagaaataagctttaactatctcggtgcgtttgacggtcttgaggggacgctgaagatgtcaccgttcaagccgcagcatgatatagcggccgggcgcatccgcgagtttgatctggatattaacgcgatcgtggcggccgggcaactggaggtaaaagccgtttataccgatgtatttgcaccgggggcaatcgagttcttcatgaatcgtttccatactcacctcggggacatcatcgcccactgttccggcaagaaagagcgggaaaaaacattaacggattacagccatacagaattgaccgctcaagccctatcaagcattgaagatctcgtaaaaggactttaatttcataaaaaggtgtgtggcattcgtgacacaagcgacagaaattcaagatatttaccctttatcatatatgcaggaaggcatgctgtttcattcgcttctggattccggatcaaacgcatatgttgagcagatttcgtttacagtcagcggggatttatgcattgatacattccaaaaaagtctggatatgcttgtcagccgttatgatattttcagaacgattttcataaaagaagtgcctgaccttgaagggccgcagcaggttgtcctttcacgccgtgacactgccgtacggactgaagacatttcagattattcggaagaacggcagcaaagcatcattgacaaattcaaggaaaccgaccggcataaggggtttgatctgcaaaaaggccccttaatgcgcctgactctttttcaaacgggagaaaaccgccatacgtgcgtttggactcatcatcacattatgatggacggctggagcttgggccttgtactgaaagatttcttcagcatgtattatgcgatccggagcgggcggcctgtaaacctcggcagtccggctccttacagcacttatatcaaatggctccgaagccggaataaagaagaaacgtcagcattctggtcgcgttgcttggaagattacggagaaaccgtttccgttccgcaaacgaagaataagacggcgcaaaacggttatgcatctgagcatttccaattttcccttgagcctgaaaccgtacaaaaactgacagacattgcccgaggcatcggggtcacgctgaatactatatttacgggcatttggggcctgcttctccatcgttacaacggcactgaagatgcggtcttcggttcagttgtttccggcaggccgtcagctatcagcggcattgaatccatggccggactgtttatcaataccgtgccggtaagggtgcgcggggctgatgatatgactttttcttctcttctcaaaaaggtgcaaaaagagtcactcgctgcggaagagcacagctattatccgctttatgacattcaaaacgagagcggcctgcaaaaagatctcttgaatcacatcctggtttttgaaaattatccggttcagatgcaggctgcggtaaacggctggcagcaaacggaaagcagtgcgctctcacttgaaaacttttcgatggcggaagaaaccaattacgatcttaacgtcgtcatcgttccgggagaagagttttatgtaaaattcagctacaatgcgggcatctacgatcgggaagacatgaaacggatcaaagggcatattctggaggtcatctcctgtgtaacggaagatccggacaagcttttatcaagcatcagtctcgtaccaccggaggaagaagccctgattcattcgtttaacgaaacgaaccgtccgtaccctgagacaactgttcatgggctgtttgaagaacaggcggcaaaaacgcctgaccaagaggcgttgagatataacggggtaagctggagctacaagaaattaaatcagcgggcgaatcagattgcccatgcgttaagagaaaaaggcgcccgttcagatcagatcaccgctgttatgctgcgccgatcaatgagtacggttgccgctctgctcggaatttggaagtcgggcagcgcctatatgccgattgatgcggaatttccgcctgaacggatttcatttttactgagagacagtgaagcctcactgctcctgactgaaaaagacctgctccccctcattccgccgcatttcaagggcagcgtcgtcatcatggaggaaacggtttcccagcagactgcaccgcttccgccggtgtctgacagcggaaattgggcgtatgtcatttacacttccggaacgacaggccggccgaaaggggtgcttgtacaacacaaagcgatcagcaatacattgcaatggcggcgtgaagaatacgggatgacagaaggagacatagcgcttcatcttttttcatacgtatttgacgggtcattaacgagtcttttcactccgcttctgtcgggcgcctgtgtactgttaactgatgaagatgatgcgaaagacgtcctttcaataaaacagaaaatcgcccgccacggggtaagccatcttctgatcgttccgtctctgtatcgcgttctgcttgattcgctgacgaaaaaggatgcgcagacgcttcgggcggtgacatttgccggggaagcggccactcctgatatcgtggaagcgagccgcaacatatgcccgaatgccgagctgctgaatgaatacggcccgacggaaaacagtgtggccacgacgattctgcgcaacctgcaaaaaagcagccggattacgatcgggcgcccgattgccaacacttctgtctatatgatgcacggagatcggctgcagccggtcggagccgtcggtgaactgtgtatttccggaaaaggcctggcggacggatattttcagcaaaaagagctgacggacaaagtctttacccctcatccgtttcgtgaaggtgaacggctgtacagaacgggagatgcagcccgatttttaccggacggaacgattgaatatatgggacgctttgacgatcaggtgaaggtaagaggttacagaattgaattaggagaaatcgaaacggcactcagaagtctgtccggggtaaaagaggcggcagtcatcgtgcgcaaaacggcggacggggaacaggagcttgcagcttatgccgtgctggaaaacgcgggtgtgacatttgatcctcatgccgaattggccgggagattacctgcttatatgatcccgggaagctttaccaaattgacggaaatgccgctgtctgtgagcggaaagcttgaccgggccgcacttcctgagccgaaagaagccgagagaaccggtgattatcaagctccgcgcacaatgcttgagactgagctgctgtctatttggcaagaagtgctgaaacgggaacacatcagtatgagagatgatttcttccaaatcggcggacagtcgctgaaagcggcgtcgcttgtttcaaagatacataaacggctgcaaattgaacttgccgtccgccatgtttttgaacatccgaccatcgagagcatggcccgcttcctagaacagaggaaaagaggagaatatgcagaaatcacgcctgcggaggcaaagggcctgtacccgctatcttttgcgcaaaaaaggctttatgcccttcatcagcttgcggcggacagtacgggctatcatatgcccgcttgtctggaactgagcggcagactcaaccgtgatcgtctgcacgaagccttttcagcgctgttacaaaggcatgaagcgttacggacatcatttgttttacgaaacggggagccgatgcagcacgtacattcacatgtcgatctcgatctcacagagattcacatgccatccgggacacttcttcaagaggcgatggaaactttcgtcaaaccgtttgacgtggaaaaagcgccgcttttgagagtgactttagccaaagccactgaagaacgtcattttctgctgcttgatatgcatcatcttatcgcagacggtgtgtcaatgagcgttctgatccaagaattgacggatttgtacagaggaaaagagctgcggccgttaaaacttcagtacaaagatttttccgtctggcagcatgagcggttcgccgctgaagaattcaaaagacatgagcggtattggctggatgcgatcggggaaaatattcccgttcttgatctgccgctcgataaaaagcgcccgcagcttcctgatttcagcgggtccgttgttcgaacgcgcctacaaaaagaaacggcggagaatttgcgccggctcatggatgagacgggttcgacactgtatatgattcttttggcaggctactccttgttcctttctaaattgagcgggcaggaggacattgtcgtcggttcacctgcggccggcagaagccgcgctgagcttgatggggtcatcggcatgtttgtaaataccgtggcaatgagaagcaggccgaaaggggataaaacattccgcgcttatttagaagaggtgaaaatgctcgccctcggcgcagccgaacatcaggacttcccgtttgaagaacttgcccaaaagcttgatacacaccgggaagtcaatcgcaatccgctgtttgataccatgctcgttttgcaaaacagtgatgatttcaaagtgaaccttccgggcttatccgtttcttcacatgcagtgaaacatgacatttcaaaattcgacttgacgcttcatgccgaggaacagccggacggctcactggattttcattttgaatacagtaccgcgttgtttgaaaaaggtacgatcgaacggtgggccggtcattttaaagagcttttaggacaaatcgcagcggatgatgagcggaagctgtctgacattcatttgctggacacaaatgagcggcagatgcttcttcaagcggaaaatcaaacagctgagtatccgaggcatgaaacgatcgtcagtttatttgaagcacaggcggaaaaaatgccggatcaaattgcagccgttatgtccgatgagcgtctcacctaccgcgagctcaatgaaaaggcggatcaaatcgccgatatgctgtcggaaaacggcatccgctccggacagattgtcggaattatgaccgaacgatctcctgaaatgctgatcgggattttcggtattttaaaagcgggaggagcttatctgccgattgatcctgactatccggacgagcggatttcatttatgctgactgacagcggcgcgcgtgttctgttgacgcaatcgggtcttgggatatccggaatggacgggctgccggttttatacatcgataagcctgaatccgtttcagcagacagaacgaaagaaatgataacgcctgaacagccggcttacgtgatttacacatcgggcacaaccggaaaaccgaaaggcgttatgacggagcaccgcaatgtcatcagccttatcacacataaaggactgccgtttgatttcggcactggagacgtctggaccctgttccactcctattgctttgatttttctgtctgggaaatattcggcgcgctcttatacggcggaaaggtagttatcgtgccgaaagaaactgcccgtgatccgcatttgtaccggcagctgctgcaaagtgaaggcgtaacggtgctgaaccaaacgccgacggctttttccggactcattcatgaagaagccgggcatgcggacaagctgaagcttcgatatgtcattttcggcggagaagcgctccagcccggcatgctgaaaagctggaaagagaagtacccggagacagagcttgttaatatgtacggcattacggaaaccacggttcacgtcacatgcaaaaaactgaatatggatgatattgagagaaataaaagcaatatcggcagaccgctggaaaccctccatgcttttgtcatggacgcctatatgaatccgcagccgatcggaattccaggtgagctttatatcggcggggaaggcgtcgcgaggggatatgtaaacaggaatgatttaaccgcctcccggttcatcacgaatccgcacattaccggcatgcggctctaccggacgggcgatattgccaaaagactctcaaatggcgagctggaatatgtcgggcggaaagatgcgcaagtaaaagtcagaggccacagaattgagctgggagaaataaaatcagcgctgcagcagctttccttcgtgaaagaggccgccgtgatcacacgtgctgatcagcacggtcagcactccatttacgcatacgcggtcctacacgggaacgaaaagataaaagaagcagagattcaggcctctctcagagcttttctgccggaatatatgattcccgcccgtttgatagagcttgatgaactgcctttgacggcgaatgggaagctggacgagaaggcgctcccgcagcctgaattaaatgaaagccttggagatgatatcagcctgagaaatgaaactgaagaaatgatggctgacatctgggaagaacttttaggtgttgaaggactcggccccaatgctcatttcttccatctcggcggggattcgattaaagcgctgcaagtatgtgcgaggctgaaacagcagggctatgaaacgaccgtccgcgagctgttcgagcatcagacactgggagaagtgtcgatgcggctccggaaagtccgccgcgtgattgatcaggctcccgtcacgggagacgtgccgctgacgccgatacagcactggttcttttcgcaatcattgccgcatgatcattttaatcagtccgttatgctcagcagtgcggacagaatcaatgaatctgctatgagaaaagcgctggcacagctcgcggttcatcatgacgcattacggatggtatgcggcacgcaaaacggatcagtgattcaatataacagagcggataacctttctgaagaagaactctttacgtttgaaacgcatgacgtgagagggaaagggtcattacaagaggaacacgccgcaattgaacaggcggccgcccgcattcaaacttccattcggctggagacgggtccgctcgtagctgtcggtttatttcatgccgctgatggcgatcatctgctgctttccattcatcaccttgtcattgacggagtgtcatggcggattttatttgaagatctcaccgcgtgctacaggcaggcgctcgaaggaaaagaagccgcgcttccggcaaaaaccgattcctatcagacttacgcgaagcaaatctctgattatgcaaaaagccgccggctgttacaggaagcagactactggtccgaaagagaaaaagcggcggtcaaaccgcttccgaaagatacccgcatctcttccaatcttctgaaagatacagatgtgatgaccgttacattgacaaaacaggagaccgagcagctgttaacggaagcgaacagagcatacacaacagagacgggcgaattattgcttgccgcgttaagcctagcgctgaacagatggaccggaaacgagacattcaaaatcagcctggaaggccacggaagggaagagcacctggagcatcttgatatcagcagaaccatcggctggtttacgtcaatttatccggtattggttgacgcaagttttcaagatcagcctgatgacggcgagcgtctcggttatcacattaagcggacaaaagacatgatgcgccgcataccgcataaaggagcgggatacggggtgctgaaatatataagcaaactatggggagagactgaatctgattctcctgaaatcagttttaactatctgggacagtttgaccgggaaatccgttccagcggcttcggtgtttctcccgtaaaagcgggaaatgaagtcagcccagactgggaacgtccgtacacacttgatatcagcggctccgtatcgtcggaatgtctcagcatgcatgtcgtgtacaaccgttttcagtatcaaaaagaaacaattgaagttttgacgggatattttcatacctttctcaagcagatcatcacgcattgcacaggcaaagaggagcgtgaatggagcgccgctgatttcagtgatgaggagttaacgctggaagatctgaatgacattatgggagccgtcaacaaactatagaaaaggagtggcgcaatggggcagcaaccggaaatacaagatatatatcctttgtcttttatgcaggagggcatgctttttcattctctgttggatcatgactcaagagcctacttcgaacaagcggtgtttacgatcagcggaaagcttgaccgggaacgattccaaaaaagtatagacactgtttttgaacgatacgatattttccgtacgacatttattcacaagaatgtggcaaagccccgccaagtcgtgttgaaaaacaggccgagccgcgttcagtttcatgatatttctcatttggacgagaaggcgcaagacaaatatgccgaccggttcagaaaagaagataaagataaaggatttgatttgcaatcagatcctctcatgagagtctccattttgaaaaaagcgcctgaacgatatgtttgtatatggagccatcatcatattgtcatggacggctggtgcttcggaattgtcatgaaggaatttctgatgatctatcaatctctcggagacggacggcttccgtctctcgagcccgttcagccatatgggaagtatattaaatggctcatgaagcaggatcgtaaagaagccgagattttttggaaaacgagacttgccgatcttgagcaaacggcgtctcttccgaaaaaatccgcggaaccaaacggcgaacttgagcaggccgttttcaccatttctgaagatcagacaaatgagctgaagaacattgcggcaagggcgggagcaacgctgaatacagtgttccaggcactgtggggcatgttgctgcagcgtgtcagccgctgtgatgatgccgttttcggttctgtcgtttccggacggccgtcggatctcgcaggcgtggaaaaaatggtgggactgtttatcaatacgattcccgtacgggtgaaaagcggttcattttcttttctggagctcgtcaggcatttgcagcaggagacgctgcaagcagaagcgtacagctattatccgctgtatgacattcaggcgcaaagccctctgaagcaagcgctgtttgaccatattatcgtgtttgaaaatgtgccggcccagcgtgaaattgaaaatgtgagtcaggccggttcatttgattttgcggtagaggattttacgatggaagaagtcacaaactacggatgcagcataaaggtgattccgggcaattctctttatatccgcttaaaatttgataccggtatatacgacgatgtttttatgaagaatatcgaaacatttttacggcatatggtgaactcagtcatttccgaccctgaaatcggcgcttccgagatcgcattgctggatgcgtgtgaagccagaagtatgatggatgcatttaaccatacagaagcggttgaaccgccggctccgacgcttcacgggctgttt

SEQ ID NO: 147 - DNA, 10932 bp, Bacillus velezensis FL50S
ttttctgatttcataaaaaagaactgcttttgattagcagccttgtctacataagaaacatgtgtgatttttgcgttcaccaattctcttggcatgttcttcacctcctttcaaaataaaaagccttctttattcagaagacttagtgctcgaagctaataaatcatttttggaattaaaataatgtgtaagactttctatattttttcgcgctctttgtattatggactccggtattaccggcactgtttcaagctcgtctggagtttgtcttagtaccagtatggcctcaccgagtttatcatcaattatatcttcactgaccaaatatccaatcaccttcccaatcggtgccttctgaggcgtttcatttttcctctttttcgcggtatgatacaggttaatgattgcattttccagcccgtataaatcatttcttataatacgggtaaaggggttagttttaccggctcctacttcagattccacataaccttggcgaggagtacgttctacctctactgttttaccactagttggattatcttcaacatctgtttcattagaactttcatttgagagtgaaaactcaaccaaatccaacttcttatttattagaaactcaaattcccagtccttatattttatcttcgccaacgtgctgattaaatttgatacaggtcttttcaattttataactatgatgataatagctacaggccaaacaattgatttgactactgatgaaacaaattccatccaattcatttataaaccccatttacgaaagtaatgaggatattatactattttattccatgtttgctaaggcttctctccgaatcttttctttttcctcagctgacagccctaatatctcgttgtctaccacaggtgatagaacgcaatgacaattcacccgctcagcggcggaaagctttgtgtctcgcggatacatacaggtttcgctgcttcctggtatcttgaattcttcatcaacaccaacaatagtgccgtcgaggtctatatgattctcacgcggattgttcttcttccctccgctgtgcctccatttcttcttagagacagccggggactgcgcataagattcatgctgagcggcagaggaagcggccagcacctccgtgatagctgttgtccgggctcttggtctatcgaaatgcggcatgtccttcagagtcagttcaatctcctgaatagaagagcctgagtcaacggcttccgttagcaccgtttccaccgcctcatgtgtgttgagctgcataatctcggccaatctctttgaccaacccttgatccagtcgatcgagcgggaggaaagaactttgaacggaacttcaggatcgattgaatccattatgacagcggccagctcttcaagcgtctgctgcagaaaatcctcggtaagttcctggaactcttcctgaaaatcatcctctgcaaaaaggttctgcgtaaaaaacaccagaagctcctgtaacgtctctgaatcagctttgcttacaaagccgttcaatccttttaaaaacctcttacgctggctcctgagcaatctggcgatgcctttttcataattctctacgtaacggggtatcttagagaggccggggaagtcaggaatcgtctccacaagcttctgaccttcgctttcctcggctttttgaataaatgaggtaagactgaccagcagcttatcggttttgttcattcttcaaatcctccaacaaatcccgcatatcttttaacagcccgatcacgtcaggagtgccgcccttggatttaaacagagccgtaaaaggatcctcagccggtgttgattcgttcttaccaattggccgattgtattcttcctccggccattcctcaagcgttttgccgagcacgcgcccggccagatccctcagatcgttaggtgatacagcaccagccgtaatgaaaggagtcagcacttctgcaatttcaagcgggtcctgaaagtccgggcctttcaactgcagctctactttatgaatttcaagatcatttaaaaataacgcgttcagtctgccagtaagtacatttcgttccggctgaaagacttgctcttcagtaatctttctggccgtgtcagctgtcgccttgttatagtcctgggcttcgccagtatagagcggcggcaatcggaaagcagagcggattttatcccggctcttttggtcatattccaggaacaaagcatcttcctgaagaatctcggccagtgacttgatgtccactttgaccggtacgatttcttcatcaccatgaatattcttccctttggctatcccttccgcttcgagcaaaagaaatttatgtgagttttccacgccttcaaggccgttcatatagtcctgcagctgtttatacgaatcctccgagagcattccgttctcgatcgtaatagcagcgggaacatgccggccctgtttaaagtacatgaaattcagctcttctgctttgcgggcgccgtataagttgacaatatgaccgatccaccggggcttcccataagcgccgctccctatcttaaaatgcacaacctcgttggcctgcttatcaataggagttctttcatcatactgccccgtttcaagattaagtgtacgcgggtcaccgtactccttaaaataaatgactcggccatcgatcatctgagcatatttacgaaaccgcttctgccttttcatagtctttaattgacctgattcaaagtatttgaaaggaacttctataggatcagatagcttgcacacccggacatattctgcggccatgtattcgatgccggcgggatgatttttaccgttacggataacctctatatatccgtttcctgtcttttcccgatcttctaaacagaagccgagcagtgtttctgctgattcatcaaaatggagatgctttatgaactcctcaagctgttgccattccttatccgcagccgctttttcggcagaatctacttcatgtgaattcatatcctttgtgtatcgcatgtcaaacccaaaccccacaatatttgtcctgtaggcatcaacacattgctgtagcattgttgaatactcagctatcatttttaattccttcaggttgtatggcggctccatgatcatgttttctgtgtaatggcctgcaaattcatcagcatatatttgttttgtcgtttcagcaggcggagcggctttaatcactcgtgctttgactgattgcttcgtcatctgataaccccctttcttccctaaccggtctggcccgctgcgggcgtccttttggtttttctttaagatcggaaacctcataatcatccagcgcgtaccatatcgctgaaaaagtatgcgggtcaatcgtgaactcgtcttcaatgatgtgacccagcttatcggtagcataggtgagcggcttcagctcatataccgtattttcacaacggtcagagcaaatgatctttttaaaccgcttgatcttcttaatatattgaagacgtgaaccttggaacttccgagcccccaccatattgaatccttgctgctgataataacgaattgttttcggctcggcggcatccgctttgatcaattcctttgtctccgcaaattcctttatctcttcggccgtcctatcgtccgtcatttgatttttgtaatactcccaatagatatagaggtacttcttctccgtgtccacagcaagccggacaatggcgttatacgattcctcaaaaccaaagtccatgccgactcgtttaagcgggcggtgaatgttggcgatatcctccataacttcttcgtgcggccgctcttcaaattgaggaagaacccgcacaccattaatgccaaagcgccccttccgcgcaatgcgataaaggtctggatcataatccttcagttcatcgagctgcttcacatagctttcgggcagaaatagattatcttccgcagttgaatgatgataataggtgtcgttcacaacgactgtacgcttttcataaagctctttatcatcaagcacaaaccgtttttgacggtcatctttgaagaaatgccggaatgtccagttatcctctccgaccgggtttgtggaaagaatcatgtggagcggcaatgtagggtgacgcaggcgcccaagcaattccttaaagccttcatatttcacctcagaacattcctcaatccatatgatcgaaatgttattgattgatttcagcttggccggcttatccagccctttaaaaataattcggctgccattcggaaaccgtatttgcatcggtgacgaaacacacctaacaacgtgatcaatctctaattcgttgacaatctcttcgaagagagaaaaagttgagtctctgtgtgtgtcataaacttcccggataacaagcgcagtccgcttctctgtgagtaatttcagaatgatcttcagtgcagcatggtaacttttcgatgacccatagccgccaaccaaaaactgaaacttttggttccagtcaaaaaggaaatcctcgaaatgtgggtttacttttttaacagtcatcagctgtcatccttatccttgcgcttacgctctattatgatattcacagagttatccacaggtcttgcggtcaagcgttcaagctcagcttgttttgtctcgtttgtcagatacatggcgcgtagcttcaaatcgtgttcatccatagagcgggtaatatcgtgcttttgacgaattgccttcagccgcctgtcggtaacacgggtcattgcttcttcgatatttaagatatcgtcaatggaccgcatcgctgtttcttccacttccgtgacaaccagccgctcgttcataagcggcacatgctttacaagtcctgttttcttgtcattagttgggatgatgtcttttaccttgcgcatctgttgaagaacacggcgctgcttctcatttaatccattttcaatcctcatgatgcgctgcatcatacgccgctcttttaaataaagctcccggatcgttaactcaatttgatagagcgggtcagtttcaatctgatcaaacagctctttttctgtatcatccatgaaatcaaacaatatggattcatactcacctgtacgcacagagtttttatttcccttgggagcggcaccgcccctgttccctttagcatttttgttaccaggcggcgccttacctcctttattcccccgagcgtttttgttgccttttggagcgcccggacgaaaaggagcgctccctttcgatttaggagcgctcccattgattttttcttcccatttatcattcgctttccatttgcggacggtgctactggtgacgcccaattcatcggcaatgtcttttaatttcttggttccgccgctctctttccacaaatgaaaagcctcgtctctgcgtggatctctttttcttggcattacatcatcacccacccccgagccatctaattgagtttgagtttgtttttaaaattcttcatccttctgaagctgtatatcgagctctatgagcttttttaggtcgtccacagtgtttacctctattcgaccgttttgaaagtctctgatccactgtgcaatgcctgcactaacaattttccgatacttttctttggattcactgatattttcaagaacatcggttttatgtaaaagcagaagcttttccttctcttcatcagaataggaacatatgtttgttttttctcttgtcatgctccccgtcctccattacaatatgaatcagagcgtgatttcccacaaacgcggccgcgtctgatcacgctctcgacagggagctatctctgttgtgattggagggtgttagcagcaccctctttttttatttaaaccattgattagaaatctgttccgcaatcctgttcatcatgataggcgggacactcattccacaaacatactgggtgctagcgcccacgaaatcataatccaacgggaacgactgcattaagatgatatctcgttcagagatatagtaaggttcatcataacgtatgaaaacagagttactagccaaagtaggcggcacaaggctgtttttgaccaagacagtattgaaattactttctttcccctctgttctcttcgttatatctcctatagtgttatctgacgggcgccgcttcacccatcgcctatatgttttagaggtctctgtcagctttgatccccggccgctcctgaactcaccatacaaaataggtgattcattaaaagatagatgcaaaggtgggaggttcagatccttccgacggccaataaaaaagacccgctctctccgctgcgggactcccattgttgctgcattcaacaaaaacacctgaacgtcatacccaatttcctttgctcgttcaatgacaagcttgacatatcctttcgctttaccgattatcattccttttacattttcagcgagaaacgttttaggcttcaatctttctacggcatccaggtattcaaaaaacaaatcgtccaatgactgtttagcctgaccttccctgaacgttttttctttcccccaggcatcctcccgttcaccagatattgaaaatacactacacggcggagaaccgtcgaacacatcaagatcaaatagagcctccggaagttcgctcaaagggattttgttaaattttcgtatatccattaagaaagaatgctgtggattatgattttttctgtatatcttcatcatttggggatcgatttcacagttccccacaagctcaaatccggcaagtttgtagcccatagatgagccgccgccgcaggagaatgtactgaatacctttaggccattccgctctacagatttcagatcggaaagcctccacttgtaaccaatcatatgcttcacctactcattaaacgagaatccgcatttcgggcatgtatgctcaaaatgatcgtcttcatattcatctaagtccagttcatggccatcagtaatcttcccgccattccccgcatgttcaggtaattcatccagaatctcgtctaactcagaatctgaaaagccagtaacaaataaatcaaaattattctcctgtagatctcgcaatacctgttcaagcttgtgctcatcccaatctccgcccgtcttatttaaagccagatttaaggctttctcttctgattcattcaggttgactacagagacagtgagttcagcagggttgctttccatatatattttaaatcgctggtgtccgccaaccagattaccggttctttcattccatacgagtggctcaacattgccaaatcgagttattgaagctttgagggaatcatattccggatctccgggctgcaggtcaatccgaggattgtatgtagcggggtttattttttcaactgatattgttttgatattcatgatgctttcgcctcctggtacaaataaaaaagcaccccgaaggatgcttaagttatattccgcttgctttcaacaaaacatcaaaaaggtgtgtcacttcacttttcaaccgcatacctttttgatgttttacggtctataaaattttacatatttgccatctctgtcaaaccagcctctgaacgcccagttatcccagccgccatctcctttgtttgtgaattccccatcttcaaacacccagatcccgtataccactccattaagaacggcagatccatagaatttgacgcctctgaagtgatcttcgtaattctgggccaaattaaataccatgacattatatttctgtccggcagagtaaaaagcagattccatcatatttttgacaaaacccggtcgatttgcgttttgcacaacagcatttcggattgaatttgctatgccgaggacgtcaagatttacattgaaattaacaccagggataccagtgctctctttagcattaaactggttatggctcattgtttgtttaacggccggtgctgatgaaacagtgggttcaacctctttttctttagcgtgggcaaaagcaggcagactggaagcagcgagcatcagagcggtgacggatgtgattacttttttcttcaattcaattccccctagagattttttaataagtgtgagatccataggccgacaacagacaacttattactcgtttcctgctttataccccccttctttatatgaaaccagtatataaagtttcttgattggaataatgatgaaaatttagtattttacgataagcaataaatcatataaatgggcagaaaagaaattagaccacgggacaaatcgatcggtcatgtcaatcaattgaggcttatttaataaaatttttagtaattttttaaccttttcaagaaaatttgtaagaaaatatcacaattgttttcaacgcggtcaaaaagacttattttcaacgctttaaaggagaacgatataacaaaacgtgagcccctattgtttacggcgaatacggccgcctgtccgtttataggtgtcgcgcttcgttcccatgatttcttcccaatcccttctcgtcagaggttcatgtgcctttgttgagggacttaacacttttttaaactgctgtttcgtatcagcagataaaacgtctctcatcttcatctttcatttctccttgccgaataagcaccgccttacgctattcgcttttatttatttgtggcccgtcgattttccccaggaggtaagcaaagaaaatggagagccgatttaaaagactttccttgcaatcggaatctcaccgcttgcgttccccgtgactatcgcgcgcaatactgcatagactccagccgctcctcctgtgaagctaacggccttcattgtcattcgatacatccgagtgcacgcttgatacgggaaaggtgcgtctcccaatctgccataaaaaagcggccactaatcagatgcacaaatagactcatgcaaaagatcagcgtccgcaggtttctccttttgggacagatattcacgttcgttttcttcctgtctctatcgtatgacaaaccgcatctaaaaaaagtacccattttatcccccattttgtcggctttttatcgggtttttgtcggctttttgtcgctcataaaaaagacagccctcagattattccgagcgctgtcgcgatattgtagatggcctgtcttttcacctgataaaacttatctcttttcaggccgagctcaatcataatttctaaatcctttatttttcttggagacaaatatttcttttcaagaatactgcgttcatcttgatcaaggcagttttctagcgccctattcatctgcttgaccttcagctcattataatcagtgttttttcgtaactgcggaaacagcccgatgattcccttttccttttgctcttgtctattttccgcttgggtttttaatgatctatacgttttgagctctttaatgacgatgttacgtacttctttttcatttacttctggaatgaatgacaattgtttgactgcttgcactctgttccctccttaaagtaatagtgcgggcatcaaacgcacagccttatgccgaatgtctgatgtccgcaattgctcattttattcgataacgaaatgaatcacttgacgtaaaattttgctgattcaaaggttccgatatggttccgcttgccggaatcagaatagcagtccagttggatgacataggttcctttcccggtcttattccgaattgttttcacgttgaatgatttcagaggcgttgcagttttgaagctgccccgctgcactaaattcgtatcagtcagcccgccgccgctacgcttcttgtacacgccggccgtgtaataaagtgtccttgagccttttttctcggctttccagtccaccgtggaggcaccggccgtgtaagtcgcggcatccgtaaacacccggccgctgtacccggattcattttgccaaccggaccatgcggcggaagcagacggcgcaatggccgtggctcctgtaagtaatactgctgatagcatgattgatttgaatagttttttcatcattgttcctccttcatatttgagcttttttctccaatacgcaaaccatgaggcacggcactaccgatgtaaacctctcaacttcatcaccatttaaagcctttgttatcaagtcgacattttccctctgttgactcggcgcaaggataatggtttccacttgatatttttccttttcgtagcgagtcattttagaccaagcggccgttagattgttatattgcgaatcacctttttgatagacacgaatcattccgcacccacctctcgacataagtcagcccgtcaggctgcaaaacacatccaaaatacggaagtctctccgctcctgtcagcttctcaacttccggatcgtatttccccaattcatcaagatcctgaataaatttcaaaaaggacggatcgaatttttgtatttccctcgccaacaaagcatcacgatagccccaaatcgtcgcaccattctcacaggctttcattaaattaatgtgtttttgctccattttcacttccgaaaggtctttactcattccgcatcccccttcaattcatgttgggcaaccgttatagtgaattgcatattcttaatagtttgctgtaaagccttcttgtatctgcttctttccccgcttagatgctgaatgtccttttgagcctgccggaattgattgaccgcaatgtcctgctggcgttggtgttcctcaatgatagcccgctgtttatcagccagttcagcttgttcaagaagccatcctatttccttttgtgggatgtaagtaagctgttttaaccgttcaactctctcactcattttcgtttcctcccccgcagggaatgcccctgctatttgatttggaatcaaaacaaactcatttgatg

SEQ ID NO: 148 - DNA, 9120 bp, Bacillus velezensis FL50S
ccgtcagctcaggccggttcagatagccgcgggccacgcctgtccctgcgatatacagctctccgatacagcccggcggcagaagctgtttcttttgatttaaaatatacagccgcatgttatgtccggaactgccgatcggaacattgtgaaattcctttccttgcggcaaatcgaagtacgccgcttctaccgtcgcttccgtcggaccgtaggaatttgtcaattccgttcccggcagaaggtcataaaaacgggaaaccaagtgcgggcccaattgttcgcccccggcaaaaaccctttttaagcaggtctttttgatcggctgttttctggaatttatatattccaagaaagcatgaagcatggatggcacaaaatgagctgccgtgatgcggtttttctccaatgcattcagtatcatttcagggtctttctcgccgccttgcggaaggagaaaaacagaagctccggcgatcggccaccaaaacagctcccaaatcgaagcatcgaaagagtatgatgttttatgcaaaatggtgtcggaatcctttaatccataacgcgtttgcagcgagtataaaaagtttacggctgactgatgttcaacctgcacaccttttgggcgtcccgtagaaccggatgtatagatgatataagccaatgaatcaggttttaccggaacattggggttgtccgcagcttccgggtttcctgtttgtccgtttttcagagagatcgtttctccctcaaaaagatctggtgcgaaaagttctggttctgccagtaagaatttcacgccgctgtctttcagtaaaaagcgaatccgctcttccggataatccggatcaatcggcagatatgcaccgcctgcttttaagacagcgtaaatgccgatcagcatgtcaggagaacgccggcccataatggcagtcttatcctccagccttatcccccgcttgatcagccggtgcgcaagctcattcgctctttcgttcagttcctgatacgtaatcgaaatgtcatcagttaaaatcgccggacggtccggcgttttttccgcctgttgttccagcagctcatgaagaggctgatgaagcggaaacgctgttttctgcaaggggctgaaattttgaagcagagacacttcttctttttctgacaaaacagaaatatcgtctaattccaaacccggatcagctgcggcgttttcggcaagtgtcgtgaaaaattccgcccatttttgaatcgtttttctctcaaacaaatcagtgctgtattcaaactggcagtacaattcaccggcgttttcggagatgtacagcgataagtcaaatttagaaatcggcaggctgacgtctgccggctgcagttcaagtccggctgccctaagcttctgctgttccatattttgcagcgcaaatgttgtgtcaaacagcggatttcgggacatgtcccgcggcacaccgagcttatcgacgagctcttctaacgggtaatcctgatgctcgtaagcctcaagcgctgtttggcgaatttcctttaaatattctttgaacgtcatgcttccgtcgggacgcgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgtgctgtatgtttttcgctgatgacaaatgacacccggtcaccggaaaagctccgcaccgggggacgcggcttatcagccggcaattcaagcacgggaatctccccggcaagccggttcagccagtactcctcttgtttccgatatgcggcgcccgccttaaatgattgctgccagacggcataatctttgtattgaatccgtaacggcggcagacttctctcagcatacagctcactgaattcacgtatcaaaagattgacggatacgccgtctgaaataatatgatgcatgtcagctaaaagcagatgccggtctttttctatttggacaaatcccgcccggaaaagaggcgctttgccgagatcgaacggccggataaacgcttcggctgattgttcttttgtaaatgcaaacggcacttcgtcatgaatcctctgcacaggccggccgtttttttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataggtttcttttgtttctgtcttttctatggatgcgaacggattctcttctgcttcaccgatgattttgacgagttcttctacagtcggatagctgaagacatcactcagcgggatttgcacgctgcactctttagctatttttgcaatgagtgccgtcgcctttaatgaatggccgccaagctcgaaaaagtgatcgtgaacgccgatcgggccggtttgaagcacttcttcccatatgcgggttagcttcagttcggtcacatttcggggagctgtatatcgacggcccgctgcgtacgctgaagcttccggaagggcccgctgatcgactttgccgttcgcagtgagcggaatcgcgtcaacgaaagcccatttgaccggaatcatataatcaggcagctctttagccaaatcacttcgcagctgagaaggatcagtcgcttgtgagacggtgcagtaggcgcataattcattttcgcccgactcattcgtttgaatcagcacggcagcttctttcacggcatgatgatttgccagaacggtttcaatttctttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttcggtcagcgccggattgttcacatagcctcttcctgtattcgctccggaaatatacaattctcccgcaattccgagaggctgaagctgtctgtttttgctgagaatatacatcttgttatgatggatcggtttcccgatcggcggatgttcaggtatgtcatctcccgcagaaatcgtatacgttgaaaccacatgggtttctgacgggccgtaatgattatgcagctgcataccgtgtaaacggagcgtctgcctgaacaaacgtgagatagtcagctgctccccggccgtaatgacatgcttcacacagcggggaaaagactgtgcataaccttcttcattgaaaagcatcttgacaaacgcagtcgggaaaaacaccacttccgttttgtgctgatcgataaacgaatacagctgagaaacatcccgtttgattgattcgggcacgatacaaagggtgccgccgctcaagagtactgaaaataactcctgatagcagacgtcaaacgccaaagatgcgtactgcagcacatttttgcaaaaatcaatgcctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgttagttccgcggggagtgactgatcccgctctgttacaacatggatgcagccgctgttttcaataacatatcggatacgctcctttggactgccgggatctatcgggacaaaggcgccgcctgcttttaaaataccgagaacggccgccgctaaagaaggagaacggccgagcatgacgcctaccggctcctcccgctttaatccgcgtttttgcagcagacgggccagcttattagccgattcattcagctctttgtacgtcactgacccgccttcataccggatcgcgatttgatccggcgtttgtgcggcctgccgttcaaacatcgcatgaatcgtgtcatactcaggcttttcagtctcttcagaaatcggcgcaagcagctgctctttttcctcaggagtgatgattacaagcttatccggcgtgatatcaggtttgtcgagaatctgggaaacgatatgtgtcaaatgacctttgatattttcgataaattggcggtcatacacgcttgaatcgtatctcattttcaagtgaatctcgtcacccggcgccaccatcaggtaaaaactgtaattagtttcgtcttccatgctgaaatcatggatgtgaaaaaggtctttcgtgtcccccttgctgttcagtacatcaagctcttgttcaaccggataattctcaaagacgagaatatggtcaattaagccttgttttacctgtgaattcgcctgtatatcataaagcggatgatagctgtatgcctgtcctttcaaagcgtccttttgcacgtttttgatcagcttttgaaacgggatgtccgccccgctgatccggacaggcacggtattaatgaacaggccgatcattcgctcgatgccttcgatttcagatggccttccggaaataacagaaccaaaaaccgcatcttctgtctggttatacgcctgaagcaaaatgccccagagcgtgtggaaaatggtgctcagcgtgacctcttctttcacagcgagctctttcagcccggctgtgtcctcttttgaaaaggaaaacgtcacttcctcttggctgctttcgccggcttttttctgcttcggcagaacagtctgctgctcaaagccttcaaggtatcgctcccaatacgaagcggctttttctttatcttgctccatcagccacttgatgtaggtcccgtacggcacagcgggctcaagcgttaacggtgtccggcggagccgcgaggcgtatatctggaagaactctttcagcacgattccgagacaccagccatccataataatgtgatgaaaactccatatgcacgtatattcacattcaccggtttgaagcagcgtcacccgcatcagcatgtctttttgcaggtgaaatcctttcttacggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaatcttccccgttattgaaaaggaggcctgctcggcgtaagcctgtgattccttttgcaggagggaatgaaaaagcattccttcctgcatataagacagcggataaatatcctgaattgcattcttttttgtcatgttataatctccccgtcgcctttttctacagttcctcaacaaaactcgctatgctgtccaaatcatcagatgttaacgttttgctgctaaaatcactaacggttttttctgcttcctctttgccggtgcagtgcgacataatatcacgcaaatattgctgtaaggtttgcagcagctgttccatcgtttctttgcggaagcggctcggcggatagctcaaactgaagtgcagtttatgttgtgcagccatcgcgctcatttccaccgcttgttcccgctgccatgtcggcgtgatgtcgtgcccgctcgcaagaccggataaactgaatgtgtgctgatcttctgtatcattgaattgccctaaatagttaaagctgatttcaggcgcttgtctgaagcggattgttttttgttcaggcggtgtcatgtattttaaaatgccgtagcctattcctttatccggtattcttccgagtgtgtctttgaccgtttttacagccgttccaagttcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaatatcttgcgtatcggtatggtaggcccggttgacctgctgaagcaaaacggacgtttcttcttctgtaagcgtaaagcttaccgtttgccgaatgctgtcggctcccgtctgatgctgcggtttttcataaggaagtccggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcatgagtgtaagcggcagataaatcctccagcagaatacgccatgacactccgtcaaccgccaggtgatgtacggtgatgaataaataatcccctgaccgggttttgaaccagccggcttttaataacggccctttttcaatatccatccgctgttggagcgcagccacttcatcttctatttctctttcccaagtatctgtctcagacagatcccaaatgtccaagctgtacagctcatctttttgaataccgtgattgatttgtctgatactttcgttttctgaactgacggtgatccggagtgcatcatgatgaatgacaagatgctccaaggcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggccgctgatcgatgactctttccgctttccggataagaggcgcgagttccttaatggacggatgccggaataagtcacttgccgtcattttccacccgtagcgtccgagccgcgcggcaacttgcagcgctttgattgaatcgccgcccaactcaaaaaatgagtcctcaatcccgacttgttttgtgccgagcacttcctgccagatcacggaaagctgttcttcaagctcattgcggggagctgtgtacgcggtttgaagcgcgagctccggttcgggcagatttttccgatccaatttaccgttcggcgtaagcggcagcttctcaagttccatcatataggccgggaccatgtaattcggcagttgcttagaaagtgatgaacgcactttttctgtatccatgtccgtctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatctccggtgcggtacatccgttctcccggaacaaaaggattagggacaaatttttcttccgtcagctcagggcggccgaaatatcctcttgccacaccgtctccgcctgtgcataattcgccgatgacgccgatcggctgcggtgttcctctgctgtttatgatatatgcagttgaatttccgacagggcggccgatcgggattgaatgatcgtatgattgttcaatcaaaaagcaagtcgagaacgtcgtgttttcagtcggtccgtatccattccatattgaaagatgcggcagcgttttccgaacccggtttacatgacttggggacagtgcttccccgccgataatcaatcgggataatccggaaaacacgtgttcattttgttctgatagatgattgaacaaagacgatgtcagccacagtgtcgtaatgccgttttgctgtataaatgtttccagaacatcagagtcgagataggtttcctggtcacttacatataaagaagcgccgtttaaaagcggaccgaatatttcaaatgtcgttacatcaaatcctaatgatgaagtaaacaacagtctgtctttcggcgtaaaatcaatataattgctgtttttcacaagacggatcacgcttcgctgttcaatcatgactccttttggcgcacctgttgacccggatgtataaatcatgtaggccaatgattcaggtccgccgagcggttcgggattttccgaacttaagccggcctttgtttgaatatcctctatgaataaacgttttccggaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctgttgtacgtccggttaataaggcgacaacactttccggaccgacgccatttgatcggagagccgccgctattctgttagcccgttcgttcagctcacggtatgtcaagatttgtccatcgtataccactgcccgggcatcgggggtttcttcagcctgacgctcaaataaacggctgatggtttcgtgtcttgggtaatcgcttttcgtctgattaaactgataaataacgcgatttgtttcagcatcatccagtacgtgaatgtcaccaagcggtattgtttggtcttcaattacttttgtaagaatacgagtaaagtaagaaagccatttttcgattgtctgtttttgatagatatctgtattgaattcaaaatcaaagctgatggaaccgtcagacccttccgccgcgtaaagcgtggcatcaaactttgcggttttatgacctgtatccgcggcttgagtcaaatgcagctcatttaaattcagggattcacgctccatattttggagcacaaacatcacgtcaaacagcggattacggcttgtgtcc

SEQ ID NO: 149 - DNA, 8945 bp, Bacillus velezensis FL50S
ccgttttgtcccgcggcacagagagtgtttttcctttccatgcgtcaaggagggcttgtttttcagcatcgctgatcagtgaaatctcaggcagctttctgtccgggctttccgccgcttgcttcagaatccgcaggaacccggcgctccacttttcaatggtttcttttttaaacagatcagtcgcatattcaaactgaaggccgagaccttcttgatccgtaaagccgccgagtgtcagatcgaatttcgccgtgccttggtttgactcatacggagtgatgcgcaggttctccagttccagtgtttctttatccggatcttctgtcgtcaccatcacctggaacagcgggttgcggctcatatctctcggcaggtcaagctttccgatcagatcctcaaacggataatcctgatgcgccagcgcgtcgagattggtttgtttcacccgttcgagcagcccggcgaaggtctgctctttttgcgtttcattgcgaagcgcaagcgtattgacaaacatccccggcatttcctgaacttcggcgctcgttcttccggcggtcaccgaaccgataatgatatcgcgctgtcccgtgattttgctcaaaaagacatggaacgcggcgtgaagcaccatatgaagagtcgctcccgatgattccattaattcacgcaccgctttttccgtctcacgccccgctctgaaacggacggattgtcctttaaaactttgaaccggcggacggggaaaatcggtcggcagattcaattcaggaagctcgccggaaaatgcggagagccaataacactcatggtctttcatccgttcggcctgctcaggttcattctgccagacggcgaagtctttatagtgcaggttcggcgacggcagacttccgcctttgtaaaggtgagcgagctctttgaccagcatgcttctggacacgccgtcggcaatgatatgatgcatatccagcagcagcaggtgtttcttttcattcagtctgacaagagcggcccgaatgagcggagccgcgctcagatcaaacggcttaatgaatgcctgaatgataagatccgctttctcctcgtccgctgcttcaaagatgtgcaggtcaatgtcagcctgttctgcgatctgctgcatcggctggcctttttgatcgataaaggacgtccgcaaagattcgtggcggttgatcatctgattgagcgctttctgaagccttgaaatattgacttctccttccatcagaagaacggacggcatattatagctgattgtctcccggtcaagctggttcaggacgtacatccgtttttgggcggatgataacgggtacgcgtctgcactgtctgccggtgtgatcatccgatatccctcagataccgccgatttttcgatatatgcggcaagcaggcggacagtcggctgttcgaacagcgcttttaacggaaccgttttgtccagttcagcctgaatattggcgaggagcatcattccttttaaagagtgcccgccgtaatcgaagaaattatcgtcgatgccgagcgtatccgtaccgagtgtctgtttccaaatgcggcacagcttttcctccaattccgtttccggcaaggctgaagcaatttgcgccgtttggctgacgcccggtttcgggagggcgtttttatcggtttttccgttggctgtgagtggaatgcggtctacctgtacgaaataggccggaatcatatgagacggcagtgtttcggaaagccgtttgcgaagctcagagcctttcagcccgctgtcggctttatagtacgcgcacagttccggcagcccgccttcgctgactgcgagaacgaccgcctcctgaatgccgtttacgcttaacagcacggtttcaacctcttttaattcaatgcggtagccccggattttcacctgatcatccgcacggccgataaattcaatcgtcccgtcaggaagcctccggacgacatctcccgttttgtacatcaggctgtccggtgaaaaaggatttgagagaaatttctcccccgtcagctgcggacggtgaagatatcctctggcaagccccttcccggtaatataaagctcgccgcttgcgcccggaggaacgagctgcattgctccgtccaatacaagcgcgccggtatttgtgatcgggcggccgatgacgggacgctgctcatattgatcaagacgctccatattgatccgttccgcaatggcgccgatcgtcgtttccgtcggcccgtagtgattgataaagtcggtatgggcgtatacgtcatgaaacttgcggacatcggacgtgatgatcttttctccgccgagcaccactaaacgaagcgggctgaaacggcgttctgacgtaaaacgggctgtattgacgatcatatggaacaatgacggcgtcagtttcatatacgtaatgccgtttttctgtatatactcaccaagctgatcaggcgcggtgtacgtctctttcggcacaatgtgcagctcgccgcccgcctgaagaatcgggaatatggccgtatagccgagatcaaatgcgtaagaagacagcagcacggatttgtcagcttcggtcaaaccggcttcacggctgaaccatgtgacataattgattagattgcggtgctccagctggacgcctttcggtttgcccgttgttcccgaggtataaatgatataggcaagccggtcggcgccggactccgtttcaagccggtcggcgctttcgttctgccattctccgtcttccattacgaccgtttttcctttataaacggcggccgcggtcatgtttctctcattgacgaccagaagcttcgttccgctgtcttcgagagagtagcggattctctcttcaggagtctccggatcaatcgggagaaatgccgctccggctttcatgacgccgagaatcgcggtaatcaagtcggccgaacgatccatcataatggccacgatgtcctcactgcccgttccgcaagcctgaaggtgtcgggcaaaccggttcgagcgttcatcaagctcacgatatgtcagacttgttccgcccgcaaccgccgtgagatcaggcgttttctgcgcttgccgttcaaacagcgaaacaaaagtgccctcaggcagatccgcttccgtccgtttttcatcagaaaggagcgcttcccgctcaggagcggacagcaggcttgcgtcggccagctgaatatccggattttcggcgcaggctttaatcagattgacaaaatgagcgctccagcggcggatggtttcgtccgcaaataaggctttcgcgtaatcaaagctcaatccgacctcttctccgcgctcagccgcttctaaggaaagatcaaatttagcgacatgatgatgcatggagtaagaagaaatctccaaatctccgagccgcagggccgggatctccatgttctgcatattaaataacacgctgaacagcggactccggcttgtgtccctcgttaacggcagtttttcaattaattcttcaagcggatagctttgatgctcaaaagcttgaaggctcgccgttttcacttcattcagaaattgcttgaacgtttttttgccggcaggatgcgaccgaagcgcaactgtgttgacaaacatgcccggcacgtcttggagatcaggatgctgtcttccggccgccggagacccgactatgatatcttcctggcccgaatatttggacagcagcacttgaaaagcggctaacaagaacatgtacatcgtcgtatccgtatcagccagcagcttcttaatctgcgccgtcacctgtttatcaagcccgaagatgacgcgttccccttcaaaactgcgctcggcaggacgcgggaaatcaagcggcagatccagcaccggcagatcgcctttgaacgtatcaagccagtaggcttcgtgctgatcgagatttgctttttcacgctgccagattgaaaaatccttataatgaatctttggcagctcaagctccgtgccttgataaagcttcgcaagatcaccgatgaaaatgcccattgagcttccgtccgtaataatgtggtgcatgtcaatcagcagaagatgccggtcttcttcaagccggatcagcttcgaacggaccagcggcgcacgattgagcgcaaacggcctgataaaggcttttgtcagctcttctgcatcttcttcccggccctcggcggtttcaagctcaaacgacacatttttatgaatggtctgcacgacttctccatctgccatgtcaaacgacgtacgcagtgtctcatgacggttgattaatgcctgcatggcctcttcaagacggtttttgtctactgatccttccagcagaagtacagcagggacgttgtagctcgtgctggcctgtccgagctgattaaggatatacatcctgcgctgtgctgaggaaacaggataatgcttctgataaggcgcttgtcggatcggttcaaactgctgttcctcctcgctctcatgctccaaataatgcgcaagctcctgaatggtcggcttttcaaataacactttaatcggcacttctttttgaaagtgctcctggattttagcggtcatcatcatggcttttaaagaatgtccgccaatcgtgaagaaattgtcagtcacacccgcttttacaccgagaataccttcccaaatgtccgcgagtttctgctccgcttccgttttcggcgcttcgtattctttttgaacggcttcagcctgaggctcaggcagcgcttttttatcaatctttccgttcgccgtcagcggaaactgattcatctggatgaagtgcgcgggaatcatgtattccggaagtgattccgaaagcgttttgcgcaggtcttccggggaaagggcttggtctgcggtaaagtaagcgcagatttcattttcatccgctttatttttccggatcacagccgcagattccgtcacattctccgcctggctgattttcgcctcaatttcgccgagctcgattctgaaaccgcggacctttacttggttgtcaattctgccgagaaactcgatcgtgccgtccggaagccacttcgccaagtcccccgtccggtatatcatttcatccggtctgaacggatcgcggacaaactgcttctccgttaattcaggcagattcacatagcctcttgccactccgcttccgccgacgcacagctccccgggcgcgccgatcggctggaggttgcggttttcgtccataatgtacgcagtggaatttccgatcggcttcccgatcgggatcgagccgtcgtagtcctgatcaatgagaaaactcgtcgaaaacgtcgtattctccgtcggcccgtagccgttccaaagcgacagctccggtgatgccttcctcactttgctgacgatatgcggcacaagcgcgtcaccgccgatgatgaggtgccggagcgtgttaaacatgcccgcatccttttgggcaagctgattaaacagcggagacgtcagccacatggtcgtgatccgctgctctttcagaaattgggcgaatcgtccggcgtcaagcagtgtctcttttttcaccgggtgcagcgcggctccgttcagcaatgcgccgaagacttcgaaggttccggcatcaaagctgacggctcccgtttgcgccatccggtcttcttcatgaaccggcacgtaattcgaatgtttgacgagcctgatgatatttctgtgttcaatcatgacgcctttcggttttcctgtcgatccggatgtatacatgatatacgccaagtcgttgccgccggccgggagattcaagtctgttccgcttaccgtttcatccgcgctttcattcagcatgacaatcgggacttgcaatgtgcccgcttgttcttgatagtcctgaactgtcagcacgagccgaatcgagctgtctgccgccataaagcggagacggtcctccggaaaaaccggatcaatcggcacataggcgccgcctgcttttaggacggcaagcattccgataacggtttccgcagaccggtcgttcataatagcggcggtccggcctttttccagcccgctcttcacaaggtgtctcgccaggcggttggccgcttcgttcacttcacggtaggtccattcgcgtccctcttcttttatcgcgatgcttgcaggcgtccggtttgcctgtgcttcaaacaaacggtgaacggcctcctcttccggaagcgccgttttcgtatcattgaatatctcaacaatctgccgctcttcttcgcctgaaacaaggccgagttcccgcacgggcgcgtcaggcgttccgaccgccgctttcatcatgcgggtcagatggtgcgccgttcgttcgatggcatcatgtgcgaaagccgctccgttgtatttgattttgacggtccacgtttttcccggatacacgatgagattgaaatcaaagctcgtctgctcaaaagcatgttcaactttaatggaaaaaccgagtctttcctccatgcccccgttttccagctctttgtccagcggatagttttcaaacgcgaccaaatgattcaagaggctgccgtccagagcggagcgcttttgaatgtcatagagcggcacataatcatagcgctcggcttccacggcgtttttctgaactgccgccatcacgtcagaaaaggctgcatctttgtcaatcttgattctgacgggaatcgtattgatgaacagccccgccatcgtttcaatgccgttgatttctgaaggacggcctgatacgacggtgccgaacaccacatcgtctgtatagttgtatttgctgagcaccgcaccccaaacggcctgaaacaggttaggccccgtgacttgatgccggttggcggtctgctgaatctgcgcgaccagctcttcatcccagacaaaagaatattcttcattttggtagtctttcttttctgatgccagacggcccgggagcaggctcggctgttcgaaatccgccaggcggctgctccaatattgttccgcctcctcataatcccggcctccgagccatttgatatagtcagagtaaggtttgccctggcttcccccggcgggccggccggcacgaagcgcttcatagttttgaaacaggcttttcatcaaaacgcccatactccagccgtccatgacgatatgatgattgctccagacgagatacagttccttctcactgagcctgaacaccgccgctttaaagagaatatccttcgccagatgaaagccctgctgctgcacatcgcgtttatagcgttcaatatattcggtttggcgcgcttcatctaattgactgatatcttcatagtgcaccttcgtcttccgctctgctaatacgacttggcgcggtttttgaagctgctggtgcacgaataccgtacgcaggatgtcatatgtccgaatcagctcattgacacttttttcaaaaagctcaagctgaaagcttccgtgaatcctaagctctaattgtgtgaagtaggaggaagaatgcggatcaagcagcgcatgatacagcattccctcctgcatcggtgtgagtgcatacaccttttgaatcgattttttgctcatatgtcacctctgtcttttctgttagagaatttccattaatttatcaagttcatcaagcgtcagattatcatcgccaagatcgctaggcgtaagctcaggtccgtcttgggccaggcagtgatctatgattttcaagaggtgccctttaaagctgtcactgaacgattgaatggttttttcatgaaattcgagagaatgataggcaaacgtcatcgtcatctgcccattttctataaatccgacaatatcaagcgcattcggcttctctgtgtcagggctcagcgattgtcctgacggcatcccggatcttgtaaataagccggaatccgacatctcattaaactggcctaagtagttaaagctgatatccggatcaatctcaaatgaaagaccctctttatgctcaggcgccgttacataacgcagaatgccgtagccgactcctttgttcgggatgtgtctgatgtcttctttcatttgtttcagctgatatgaaagatcgtcggcgtgcttcatctcaaggatcatcggatacatgctcgtaaaccatccgaccgtccgggtgatattcaggccgtcaagaatgtcttcgcgcccgtggccttccaaatgaacgccgatcgtgtcttcacccgtccactctttcagcgccagtccgagcgccgtgagcaggatgtcgttcatttccgtatggtaggcttcatgtacgtttgtcgtcagctgttcagtttgttcaggcgtcagagagaagctgaccgttctcgtatgtctcatgcgctgatcaccagactgcctgtctttcggaagctgagtgcatacctctttttcctcaagctctctccagtaatccgcttctttcagaaacgccttcgtatttgcgtattctttgattctctcagcaaattcggcgaatgaatgtgttttcggcggcagcgccggttcattgccttgcttcagctgcgtataaacggacgtgaagtcctccagtaaaatccgccaagatacaccatccacgactaagtgatggattgcgagaagaaggtggtctccatcttcagcccggaagagcccggccttcagcagatgtcctgtttccagtgaaatactgctttgaagacggtctgcttcccgttcgatacggtcctcatggtcttcagcaggtccgttcagctcaaagacgttcagttcaacagacgcatcctcaagccctctgtaatacggtttttgttcacgataaatcatccggagcgcatcatggtgcaccgtcaggacatgtaatgttttttctgttatctccggatcaaagccgtctttc

SEQ ID NO: 150 - DNA, 8686 bp, Bacillus velezensis FL50S
ctcggcccgtgcagattgagcatatagctgacgcggttcggccctgctgacggactcatatttgcggctgacgcaccgccgatatccagatcggaaaacagtgagccgtacccggtattccccgtgccgatatacaggccggttttcgtgccggaaaggcttttagccgaatatcccgcatcttctatcgccttccacgcatacatcattaacaagcgctgctggggatccatctgttcggcttccagcggtgaaattccgaagaacagcggatcaaattccgcaactccgtcaataaatccgccccactttacatttgttttgttggcttcgttaagcgggtcaccgtaatactcccgccagtcccagcgatccgccggcacctctgttatacaatcttttccctcttctaaattgcgccaatactcatcaatatttgcggccttcggaaacactccgctcatgccgacaatggcgatcggttccggtttatgttcagccgcagtctgaacatgctgtacggctgtttttgcaaatcgtttgttccctgccagtctgatgccgccaccatctgttacaccgctttgcttttcttctttcggctgtgtgctgccggcaaattgcgtttgatagtcttctgctaaatgatgcgccaaggcttgaatcgtcgcatattcaaaaaatacggtcggtgtcagatcaagctgataagtgtcattcagcttgttcgcgaattccgtcagcgtaatggaatcaaatccgtattgattgaactccaattcgatatcgatttcttcaatgtttattttcagaagtccggaaacttcttttgccagcaattcctgaagtttggccgtcaggtctttcggcgcaggcgtttcttccgttttcttaaccggtgcaaaagcggctgcgggagtcttttgaagcagtttttcccgcattacggcgcggtttccttccataacgagcacgcttgttttccccgtgctccatgctttgtaaagagcttctattccggtttcagtgcgcatcggcgttacaccggttcttttttcggtgagcttcgccatttcttcattgacttgcattccgccgtctttccaaagcggccaattgattgacaatgtgtgaccgtggcggtacattgccgtaaccagcgcgttgcggtatgccgcatagctgtccataaatgcgtttgccgccgcataatccgcctgtcccgcattcccggtgacaccggaaatggatgagaaaacgatgaaaaagtccagcgctaaatgctcggttgcttcatcaaggttgacaaatccgtccgttttaggagccaatacactgtaaaactcttcggttgttttctttgcgatatattgatctctcatcacacccgcgctatgaatgatgccgtgaaggccgccatattccgtttcaattgttttgaccaggtctgccgcagtttgagcgtttgttacgtcagcctgtttgtattccgcttttgctccgagtgattcaagcgattgcagctgcttccgctgattctctcttaatgcggaacggcctgtcaaaaccagcgtcggctctttgactttccgggcgatttctttcgcgaaaataaagccgaggcccccggctcctccggtaatgagataaatccctccgtcgttccacggaatgcgtattttgccgccggacacggccgtttctttgacatctgcgctgtatcggatgccgttttcatatttgatatggctgtcatcagcccttgttttattttctctgatgatgtctgtgattctgccgttttccgccggttctatttcaatcagctgggttttcagttttttatgttccaggccggctgtttttagcagagctgaaatccctgagagcagctgatgcttatctgttttagagagaaccgtctggataaggacgtctccttccgtctcttccttcagcagtttttgcagcgtctccaatatccgtcctgtataatcacggaagcgcgccgccgctttcccgtgcggggaggtcatttcaaaacattcagctcccgcggcttcaacggcttgttttaatccggcgtctgtgtcacaaagcattacgatatgccgggcaaaaacgggttccgtttgaacggcagtttcatcgcttcgtgtccataccggctcaagcatgagcgtttccggagctttttcttttttctcaggttctttttcagccgttctgaatgacaaacctttcagccttacgcaaaccttgccattttcatcacaaatatcaagatcgcgtttttcaacctggccggctttgtggtcttcagaaagtctggcgtaaacccacatctcggcagcgcatgcgctgaatacttcaagctcctgaaccgcaaacggaagcatcagttgttcatcatttgttccggttaatatgcttgatgcctgcaatgcagagtccattaagcccggatgcatgacatactcctgtaccgtgtccgcacaagccgcattaagagacagtctgcccaatacgaaatcatcacctgtataaatcgctttgactccccggaaagccgggccgtaatcaaaaccgattttgcggtacatatcgtacacttcatctgcagaaaacggtgtctcggcggattgtgatctcagtttttggagatcaatgaccggagcctttgcgtcagggcggactgatactgccccttggctgtaaacggacggctgatctgtttcccggccgcagtaaatgtcgaattgaacgtcatttgccgtttcgggaatgagacggatgttgacatgaaccggctcgtcttcaatggtaatcggccgcacccaaaccgtattcttaagcttgacgcttccttgtccggccggaacttcagatgcctgttccattgctgcgcgcgccatttcaagatgtgccacacccggtaaaatcggcacgccttttacaacatgatccgcaaggtaaaactcttctcctgtatagattgagctgaaccgctgttctgcaaggtttgaagtatttctgtgcagaagcggatgaagcgcgtcttgttttccggcagatacagtgcttgttttttcgtgttttccggtgtgtttcgccgcccaatagcggtcttttgcaaaaggatacgacggcaggctcatacgtttaggcggccggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaaatccgcatgcttatctccagtgataaactgtgacagtttttcctgcagttcttctgcggatccggcaataaccgccaggcgttcttccatggcgtcccttccgatttggagagtatatgccatagaaacgaggctggaatgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgcggctgttcgtttccgcgttcgtccgtctgcgtcttccattccatcgtctcccgcaccagataaaacgggctgttttcaagctgaatgtacggatttaccgtctcacagtggagacttttgactaatgtgcgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcaggccgttaatttcaacgggatctcccaattctgttccggtgccgtgcgcttcgatataagagactgttttcggatcaatgcccgcttttttgtatgcggctttaataacttccgcctgttgtttcgggttaggcgttgttaaagatgccgcacggccgccgtgattcaccgcgcttcctttaatgacgccgtaaatatggtccccatccgcctcagcggctttcagctttttaaggaaaaagagcccggctccttcaccatgggcaaaaccgtcagcctgatcggagaacgttttgcatcttccttctttgctcagcgcgcccgctttgtcaaagctgatatacacatccggaagaacaatcgtattgattcctcccgccaaagccatgtcgcacgtcccttcttcaattgaagaaacggcatggtgtatggcaacgagtgagcttgagcaggcggtatcaatcggctcgctcggcccgtgcagattgagcgtatagctgacacggttcggtccgacagacggacttgtattcgccgcggatgacccttcaatcgccgcatcggcattggctaaaagagaaccgtagccggtgtttccggtcccgataaacacacctgtctttgtgcctgagagactctttgacgcatatccggcatcttcaatcgctttccacgcatacgtcagcaagaggcgctgctgagggtccatttgctccgcttcccgcggtgaaatcccgaaaaacaacggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggtcccgctgcactgtctgcggaagtgtctcaggcagagtgcggcgtcgcttaacggccgggcgcgtaatttgagtctcttttaccggtcttgccgattgaatcgtttttgtatttaccgcaaaccgtccggcaaattcctcttcgtactcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattttgtcaatgtttacttttaacagcgaggccgtctgctgttttaacagatgcttcactttttcaagcaggctgtcagcatcaatgtcatgacgtacgccggtctctgcttccggatgatcattctctttgcggaaccgttttgctttcatgtgtttcacatctccttcaaaaaccgtcatccgggctgtcccgctcatcaagccttgatataaagccttgatgccggcatctgtgccgagcggtgcgattcccgcctgctgcatcagcatatcttccgtctgctttcctgcctgcattccgccttctttccataacggccagctgacagaaagcgtctttccgtatctttgtcctgcggcttgtaaagaacggcggtactcggcatacatctccataaagacatttgcagacgcataatcagcctggccgacgcttccaagcacacctgataaggatgagaagacaataaagacatctaatttctcatgttgtgacgcttcatcaagatacacaaggcccttcactttcggagcgagaacgtgttggaattcctctgccgtcttcttcaccatgtagttgtcttttataatgccggcactgtgaacaatcccgtccagcttgccgtgccgtttacggatattgcggatcaatcggtatacttctgcttcgtccgtgacatcggtctgctcgtagaaaacagaagcgccggcagcacgtactgtttccagcatgtctttctgcttttctccgagagcggaccggccggttagtatgatgacggcgtcttttgtacggtttgcgatctcttttgcaaaaatcagacctaaacctccggcacctcctgtaatgagataaacgccttcgtctttccacggaatgtccggctccgcttgagaaatatccatctcttcccaatcagcggcaaagcgcttgccgttttcatatttcacatggacgctttcggcatgcatacggttttccgccgctttttccgcgatgccttcagcactttctttctcctcggcttcgatcatttgacagatcagcttggaatgttcaagacatgcggttttgaagaggccggtaatgcctgagaacacctgctgtaagcctgctgaccgcgtaacagcctgaaaaagaacgcggcccttcggcttgcttttcattatggttttgatatggccaaacagctgacccgcataagaatgataccgctctgcaatagatgcgggacgatcgtccaggataatgacgcgtgcatgttcaagctttgcttcgacagcttgtttaacggcttcatcgtactcacaaaggaaaatgatatgatcttcatacgaaggcgcgtgatcggccggtgccggctgctctttccagaccggttcagcgaacaatgtgtccgtacggctgaccgaaacgccggcacccgcgttttcttccatgatccgcgttgagaaacctctcatccgcacacaaagcccgccgttactgtcatataaatcaatatcggctttttggataggatcgccggctttattgttcgcactgaatgtgacgtgcacccacatatcatcagcgcacggattcagaacgtccagctcctctaaagcaaacggcaatgcggctttgaatggttccccgctttctgccagcagcgctctcgtcacgttttgcaaatattcggcggcctgaagcgcaccgtccatcatactcggatgaaggatataatcagctttcgtatgggagagggattcaggaagcttcaatttagcaagcagccggtcttcgcctttgtatacaagctggacacctttatagccaggcccgtaatcagctccgatcattcctttgtaaaacgcttgagattcgattgttccctgcgtgcaccggcgcttcagctgctcaatatccgccgcttcctccggttccttccggatgatttcagcgatgccctgattataaagaggagcttcttcaccgatagaatcgttaccgccgtacattctgtattgaatctgtccgtcctcttcttcataaagtccgatatggacacggacagcgtcctgatcgactatcaccgggcggacccatacgatattctttaagcgcaggccgagagaatcctctgttgccccgccgatgcttttctccgccgcggcccgtgccatctcaagggtgacggcagccggcacgatcgccattcctttaatgatatgctcggcaataaaatactcttttcccgtaaattccgaactgaaccgctgctcctgcaagacggatgtattctgatgtaccagcggatgcaaaaacttcgcatctgtttgcttcacagtttcttccggccagaagcgctcctctgcgaacgggtaggtcggcgcactgattcttcgcggcgcggaatcctgatacaataagccccaatcaacacgcgctccttcaatccagagcgccgcaagtgctttcagcttttcatcacgtgtctgacatgccgcaagctcttccatctcctgagccgacacttctctgcttctcactttttcgccccgtaagatgttttggtcattgccgttgatgaaatcctgcagctgacgcttcagatcgtgacgatcatgactgataaaaacggctctctcttccatcgcttcacgtccggtctgatacgtaaatgccagatcatgcaaggaaacatcgttttcggcttcatccagaaagccggataaacaagttgcataggcagtaagacgctgcttatttctcgctgacagcggaacgatataagacggctgtccgtcatttgatccgctgatcgttttgttttcatactgttcaaaaatggcgtgtgcgtttgttcctccgagtccgaatgaacttaacgctgcccggtgcggcgtctctctctccggaagcgattttctcttatccgccacataaaacggcgaaccgctgaatttgatattcgggttcggtgacgtgtaattaatggtaggcgccagctcccgatgatataaactcatggcgactttgatgcacccggccagacccgctgctgtatccaaatgtccgatattcgtttttacggagccgattccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacatcagtctgaccttttacactcggtgcgtaaaaaccgactttatccgctccgtcattgttcagaccgatgcctctgagcatggcgtatatgtgatctccgtcctgaacggcttgcgacgcctttttcagaagaatgacggcagctccttctccgcccgccataccgtcggctgaagcgtcaaatgccttgacatgcccgtcgcttgaaaaattca

SEQ ID NO: 151 - DNA, 7481 bp, Bacillus velezensis FL50S
ctgctgcaagcggaactcgccttttttctcgatggctttccaccacaccttgccgcccatcgtcttccccttcggcctgtcaattgtgcggtgagcaaccgtttcaatgacctccagcggatcatctcctaatacggattgcagtgtttcacttgatctgaaaagcgcgcaaaccgccacaacgtgcggccattccgcaagtgcccgccctttctcaatctgcaccagcgactttttagaaaggccgatcacatccgccattttctcctgtgtgtagcctctctccgaccggattttcttcagctggactgagacaagctcagtcatataatcttgatccatctcaacctccatttttatcaatatagccattttacaccgcggcacgccttttttatatcagaacattttcaaacaaatcaaaaggacccgggatcggcttttcattgaaacgatgtacctttccgcataatccagaatgatgcggtgaatacaaacgtacgtacgcccgaagagacagatggctccctggcggttgagctccggagaaaataaaaagctgccgcagctgcggcagctaaaacattataagctgaaaatcaaaattatgaagcgaatacaatccaactcgcactataattgacacgttttttcgaaccttgattgaccattttaaatctgtatgaatctcctttttttaacgaaggtgtttcaaaataagtcgttccatttttctttgcattggcggttttgattgttttccaggcacctttgccgttgacttgcttttgaacgtatattttatacgtgcccttccctttactgttggatttaaaagtcacggctctcaagctgtacttttttgtcgtcttagtgaatttaggatgatatgtattgatcacatagttagtgaaatacccgcttttataagtatgaagccagtctttagcctctgctttttgcggagaagaaaaacccataaaaccaattccgctgattaaaagagtaaaaataatgatgagcgacttaaaaatctttttgcttttcatcgagaaaatccttccttcctgtaactatttaccctatttatgttaatgacaatatagctaatcataaatccgtccaactaaccattttgattgcaggaagagatgagaacagccctgaaaatgactatatgactaatacttatgattcttgttatttttgattaagtgataaagttactttaaagcgctatccattttgctgtttttgtatcaattgtcatagagagatctttacctatcaatgcctctctatcggcgtttgtatgatggggctgtcctcggacaaactcctgcgcccatgacaaactgtcatacgtttgccacctatgaatgaacgcacactacacgtaatggagggattgcaatggacgaaatggtcctggaaacacaacaatggctgaatgagacgtacaaaggcagacacgggtacaacaaggtgccggaaaacggaaaaacaggctgggataccatttacggtctgacacgggcgcttcaaattgagctcggtatttcagaacccgccgataacttcggaccgacgacacaaagattgtttaaaccgctgaaaaagcaggctcccgattctaagccgacaaacatgaattacattctgcagggggcgctgtggtgtaaaggatttaacccgggcggattttctggcgttttctatgaaaataccgaaagcgctgtaaaagagtttcaaaaagcggccggacttactaagcaagacggcatcgtcacggcactcattatgaaggctttgctggatatgagcgcttttcggttagtagcgggaggcgacaaaagaatccgccaaatccagcagaacctgaaccgggattacaatgactacatcggcttgatgccttgtgacggcttatatgctcgcgatacaaacaaggctctcatctatgctctgcaaaaagaagaaggcatgagcacaagcgtcgccaatggatttttcgggaacggaacgaccagcttatgtcctaccttgactcccggcgattcacggacaggctttgttttgattgttcaatacgcgctttactgtaatgggaaatcatttgaccccggtgaattcgacggaaaatacggcgtcggagttgtatcggcagtgaaagctttccaagaatttatgtgcctgccgcagacaggttatgcggacatgccgacgattaaagctttattatcaagctcaggcgacacaacgcgggctgcttcagcttgtgacaccgctgccattttgacggcagatacggctaaaactttgcgtgagaatggctataagatcgtgggaagatatctgaccgggaatgtgcggactagcagcggactgacatcgaaagcgttaacgtcaaaagaactttccgcgattttcaatgccggcttaagcgtgtttccgatttatcaggacggcggctatgaatcttcttattttgtaaaagaccaaggaacgagagatgcgtacagcgctgcatcagccgcccgaagattaggttttccgtcaggaacgaccatttactttgccgtcgattttgatgcgtatgattatgaagtcacggataaaatcatcccttactttcaagaaatcaagtcagcctttatgaaaatgcaggcgttctcaactgcgccgaaatatgaaatcggggtatacggaccgagaaacatttgtatccggacgtcagaagcaggtctgaccaaatatagctttacggctaacatgtcgaccggattcagcggcaacctcggatacccgatgccgaaaaactgggcttttgatcaattttatgaaggaacgatcggaagcggagcgggaaaagtcgccattgacaaagacggatactccggaaaagactcgggtgcaagcagcgtccatccgccttctgatcccgtgtatgatgcaagactgcgcacactgacggacattttaacaaccattcctgctttagaaaatatatcgaatcttgcgaatgccatgtttgaattcgacaagacagaaaccatttatgcatcacctgaaatggatattcttttatctacttcacttttggcaacagtgccaagcgaaggttctcccaacacagttaccattacaaatggcaaaccgggagcttatattaccggtctgatgggagattcacaagtctcttttacagcatcacaaattgattcgtatcaaaacctgcttaacagtctgagcttgtcagtccgcaacggttatttagaagtgtatgtcaatccggctgcgggatcgctgaatattcaatttaaaatttatacacctgatattccggtcggtgacagtgctactactggactaacaactaccattacatttaaaataaaacaaaagagcttcagattgccggattccgaagaagtgtactctccggattgggattctgtcgtgaataccatggctattgcaggcgcaggaattattgttattgtagggatcggtgctttagtcgttttagcacctgaattaggaggagctgcagccttgttcagcacagttttatcactatttctataattgaacaggcagctccttgctccaggaatgctcaatgagtattcttggagttattttttaaggaggattcgtatgaagattgatatgcagacatacaaggacaccgttcaaaaaatagaaaatgatttgattccgcgaagtcaaaatgacaaagaactgcttacatatttaatgaaacaagattcgctcacactgaatcaaatgaaaatgtgtttcactgaaccgctcctcaccttccaacatactgtcaaaatcgtatgtacagtcacattcatcacgttatatatcttttttttcagcactcattttaatgatttgattgaaatggctctgcagatggtttttggcctggccggccttgtttggatttttgctgtatttccgttttcaaggaaaatccaagtgtctgaccgtttcagacaaaaatctgaaaacacccgtatcaccggaatgatagactttgtcctcgaacaacgatacaaagacatgatcagttaaaaacccctctgcttaaggggtttttttatgatgcaatcccttcaccccccttatcaaaaaaggctcttcccctttggaaataaccggaacacccaatttcgttttcaatataatgaggtagtggatctgcaaagaaagaagggcgacatgatgggtatcattaatggcaaaatgttcattgaccgattaaatcagctaggaaatgagatttggcttgatggtgaaaagatcgagggacagatttctgaacatcccgcatttaagggccttctggaaacgaagcgctctctttatgatttgcaaacgaaaccggacatgaaagatcaaatgacttacagtcttcccggtaaaaaagaacgggccgggctttcatacctgcagccgaaaacgaaagaagacgtaaaaagaagaagaaacatgttcgaacattgggccagacacacgcacggaatgatgggacgaagcccggattatatgaataccgtgctgatgagcttcgcctcctctgccgcgcttttgaaagaccgtgatcattgttttccggaacatgttcaagcgctgtacgaacgcgctgccgcacaggatctttcttttacgcacacgtttatcacccctcaggtgaatcgttcacaaatgggtgtaaacgtatcgccgacacctatctcggcaaaagtcgtcgataaaaatgaaaaaggccttatcatacacggcgcgcggattttggccacacaaggcggcctgacggatgaagtgctcgtggtttctctgcctaagatgtattttgaatcggatgaagcgttcgctttttcaatcccttccaatacaaaaggagtaaaattcatctgcagggaatctttcgtactcggaaaatcatcatttgattatccgctcagctcaagatatgaagaaatggattctatcgttgtatttgatcacgttttggtcccttgggaacgcgtatttttttacaataattacgaggcggcttttgattttaatatgaaaagctcttttaacgccttcgcatttcatcaagttatcacgagacaaattgtaaagacggagtttctcctgggcctcgcccaaacgcttgtcgatgcgatagatgtgggggaatatcagcatattcaggccaagatggctgagatcatcaccggtctggaaacgatgaaagcccttttggaaaagtcggagaatgatgcggaaacagacgaatggggttatatgcatccgagtgtcactccgcttcgcgtggtcagcgcgattttccctgacatctacccgcgcttcacggaaatcatccagctgatcggggcaagcggaatggtgactttgccgactgaaaaagcgttccgttccgacatcagaggagaccttgaccaatatttacaggcggccgaattgaacgctgaggaccgggtaaaagtgttccgcctcgcatgggatttgaccatgagcccctttggaacaaggcagacacaatatgagcggtacttcttcggtgaccccgtccgcttagccagccatctgtacagaagctatccgaaagaagaacagaccgcggtcatcaaggaattcctgcacattcataaataaaacaaagcagagaacgcatctctgcttttgatagctggatcggctgccgccgatcctattttttattttggctgatcaccaccatcgtaatatgcgataacgcgaaagagacgagcgtgtatacgacggcccacccgataaacgagaaattcaatatggtaaaggtgcatataaggcaaacggccaaagcggcagccggcataatgaacgcgtttttaaacaggtacgttccggcgactgacaggatgatgatacaaagcggcagaacaccgaacgcaaaatccaattcatcaatcaacagatgcactcccttcgcttttcttagttcggcctaacacatcttatgcctgagtacaaaatcgagtacatcaaatctttcgcgctccggctgatattccctccggttatttattcaaaaaaatgaaaactttccttaaagcgtttacattcacgccagactgtgataatttaagaaagcgctatcatatacaagttaatgatttttggatggagatgaggagaaccaggaaaccgcgccctttcataagggtgatttctggttctttttgtcattttcaaggaaaggagtcatacatacatcatgatagacgttcagcaaaggggaggatatgatgtttcaattgttcaagccggctccgcatattgagagattggatgattcaaagacggatgcggcctataaacggctcaggctgcaggtatttttggggattttcatcgggtatgccgggtattatttacttcgcaaaaactttgccttcgctattccttattttcaggaacaagggttttcaaaaggggaacttggcttggtgcttgcggccgtatcaatcgcttacggcttcagcaaatttattatggggatggtgtctgaccgctgcaacccgaggtatttccttgcgacaggtctgtttttgtcaggtgtcgtcaacattttatttgtttccatgccatgggtcacgtcaagcgtgacgattatgttcatttttatgtttattaacggatggtttcaagggatgggctggccgccttgcggacggacgatggctcattggttttccatcagtgaacgcggaacgaaaatgtcgatatggaatgtcgcccataacataggcggaggtattctcgccccgctcgtgactctcggcatcgccatgtttgttacttggaaaagcgtatttttctttccggcgattatcgccatcgtcatttcatttgtgattgttcttctcgttcgggacacgccgcaatcctgcgggcttccgccgattgaagaataccggaatgactatccgaaacatgcgttcaaagaccaggaaaaagagatgacgaccaaagaaattcttttcaaatacgtgctgaataataaatttctgtggtatatcgcatttgccaatgtctttgtttatttcgtgcggtacggtgtcgttgactgggcgccgacttatttgacggaagcgaaagggttctctcctgaagattccagatggtcttatttcctttatgaatatgcgggaattccgggaacgattttgtgcggctggatcagcgaccgatttttcaaaagccgccgcgcaccggccggcgtgctgttcatggccggcgtatttatcgctgtattggtctactggcttaaccctgccggtcatccgctcatcgataatatcgcgctgatcagcatcggattcttaatctatgggcctgtcatgctgatcggacttcaggccattgaccttgcgcctaaaaaagcggcgggaacggcagccggcttaaccggg

SEQ ID NO: 152 - DNA, 7214 bp, Bacillus velezensis FL50S
cacagcaaatgcccagccgttttccgatcaagacagcgccgccccgtcacaggccgcagtcagcggacttgccggaacaatggcgaaagaatatccgcattggaatatccgcatgattgacacggaaacggacggcagctggccggtcaaagaggcgctcagtctttctgccggaaaaaacggtcaaatttgggcgtaccacaatcagcagctgtttgagcggcagctgataccgcttgacaatatgccgaaaaacggcacgctgtaccaaacaggcggggtttatgccgtgatcggaggcgccggatatcttggcgaggcatggagtgaatacatgatccgccgctacaaagcacatatcatttggatcggaagaagcacactgaatgattccatacaggcgaaactcgaccggctcagcgcattcggcccggcgcctgaatatgtttccgccgatgccgctgacagtgcttccttagagcgggcttatcagttcataaaagagcgtcacacaaaaatgaacggaatcatccactcggcaatggatctgtctgagcaaagcttaaataatatgaagacagaagagttcaaatcggtgctgcgggcaaaagccgatgtcagtgtgtccatggcggaggtatttggacgggagccgcttgactttgcgctcttcttctcctcgcttgtggcatttatccataacgtgaaacaaagccactatgccgcaggatgcgctttcagtgacgcatttgcgaaagaacttgatcagacgtggaattgtccggtcaaagtcatgaattggggctattggggcaacagcgaagcggctgaagacggcgattttattcagctgatggatcagatcggattgggattgatcgaaccggacgctgcgatggaggcgcttgaaacccttatgacgctgccggttgatcaagcagctttcattcatacgacaaaaccggtcgcagtcgaagggatgagtgaaacagaaaaaatttccgtttatccgtctcagccgcttgtctcttcacaacagctgaaggccgctccgcccggcgcacgtcttgtaaaagaggctgaacatcaaaagctcgatgattttctgtatcagcttttgatcgcccagcttaaagaagcagacttgctgacgccgcaaagccttaaagcgtatgagcccgaacacgaatattttaaaaaatggctcaatcaaacgatcgctttccttctggaacatggttatctggaagggaatgcggattcatataaactgtcggcccgtgccgaagacacaaccgcctcgctatggcaaaaatgggagcaggaaaaagaggaatggctcaataacgccgatacaaaagcgatgactgttttagccgagacgatgcttaaagcactgccggacattctgcgcgaagacgtgccggcgactgacatcatgttcccgcactcttcaatggaacttgttgaaggaatttataagcacaatcaagtcgcggattactttaacagcgccctgtcagatacattaacggcttatgtgaaagaaaacatcagcaaacattcaaaagccgagatccgcatactggaaatcggagcgggcacaggcggcacaagcgcaggcatatttgaaaagcttaggccgtatcaaaaccatataaaagaatactgttacaccgatgtatcgaaagcttttctcgtgcatgcggagacggaatacggcaaacggaatccttatctgacgtataagctttttaacgcagaagcgccgcttgccggccaggacatagagccgggcgcatacgacatcgtcattgccgccaatgtgctccacgcgacgaaagacatccgccagacgctgagaaacgctaaagccgtcttaaaagacaacggtttgctgctcttaaatgaaatggcgggaaacagcctgttcccgcatattactttcggactgcttgaaggctggtggctgcatgaagattctgcccttcgtattccggggtgcccgggcttgtatccggaaagctggaagcgcgtgttagaaagtgaaggctggcattctgtcttcttcccggcagaagcggcacataaattaagccatcagattatagcggcaaaaagcaacggcgttgtccgccaaaaaacgcttaaagcaggggccggaaaacggaccgctccgccaaaagcagcacaagcgccggaatttaaagcgccgcaaacaacggtgcaaaaaggcgacacgtctttaacagaaaaaagcaccgagtacttgaaaacgttaatcggagaaacgttaaaaattccgccggctcaaattgatccgaaagcgccgcttgaaaaatacggaattgattctatcgtcgtcgtacagctgacaaacgcgttacgaaatgtattggaccaagtcagcagcactttattttttgaatatcagacgatcgaagcgctcgtcgctcacttaatcaaaacgaaaaaagacgcgatgatcaaactgacgggacaaacgcctgttcaggaagaacggaaggcatcaccagaaccgcaggctgtacagccggccaagccgcttcgcactgactggcggcggagggaaaagcgggcagccagagagaccgtccggcaaagttcggttcgcgacgtggccatcatcggtgtttcaggacgctacccgcaggcaaaaacagcggctgagctttgggccaatattaaaaaaggaaaaaactgcatagaagaaattccgcaggaacgctggaactggcaggattactatgatgaagagaaaggtaaagaaggctctatttatacgaaatggggcggcttcattgaggatatggacaagtttgatccgctgttctttcagatttctcctttggaagcggagcgaatggacccgcaggagcgattatttttagaaacggcgtatgcgagtatcgaggatgccggctatacgcctgacaacctgtgccaaagcagaaaaatcggtgtttttgccggcgcgatgaacaaaaactacccgacaggctacggctactggtccattgccaacagggtatcttacctttttgatttccaagggccgagcattgccgttgatacagcctgctcctcttctttgacagccattcatctggcgcttgagagcatatacagcggttcaagcgaatgcgcgattgccgggggcgtaaacatagtgaccgacccgattcattatatgaatctgtcagtcatgaacatgctttccgcaagcgacacgtgcaaatcgttcggagaccgcgcggacggttttgtagacggagaaggggtgggcgcggtcgtattaaagccgttggagcaagcgattgccgacaacgatcacatttacggtgtgattaaaggaagcgccattaacagcggaggcaaaacgaacggatacaccgttccgaatccgaatgcgcaggccgccttaataaaagaagctttcgaaagggcaaacgtcccggcgcgcaccgtcagttatattgaagcccacggcacggggaccgcattaggggatccgattgaaatcgccggattaacgaaagcatttgaagaggatacaacagacaaacagttttgcgccatcggctcagcaaaatcaaatatcggccattgtgaaagcgccgcgggcattgcgggtctgacaaaaatattattccagctcaaagaccgccaaattgcgccgtccctgcacgcggaacagctgaatccaaatattgatttcgcgtatacaccgtttgccgttcagcaggagctcggtgagtggaaacgtcccgtcatcggcggcaaagagcttccgagaagagcggggttaagcagcttcggcgcgggaggagcaaacgcccacctcattatagaagaatatacgccagacaaagtgcctgatgagacgccggcagatcagcccgccatcatcgtcctgtccgcgaaaaacagcgaacggctcactgaaaaagcaaaacagctcagagacgccatccgtgaaaaaagatacagcggccgcgatcttatgagcatagcctttactctccagactggccgggtgccgatggaagagcgtctcggctttatcgtccattcacttcatgaacttgaggaaaaactgaacggatttatcgccggacaaaacagcgccggactgcaccgtgacggcagggaagaaaacaaacggatgcttgccgtatttgcggccgatgatgacatggaaaccatcatagacgcttggatcagcaaacggaaatattctaagctgcttgagctttgggtaaaaggattggacatcaattgggcgaaattatacggagaccgtcctccggtccgcatcagcctgcctgcttatccgtttgcgaaagaacgcttctggcatcagcagcctgtacaaagcaaggccgcgcccgttaacgcgccggctgatgaaagtgatccggcggagcagtttgaagtaatggcttttagagaagttcttaaagaacaggctctgccggctgccggagaaaagcaagtcaaaacggtgatttctttcttaactgatcagaagaagcagcaggaagccgtctctgtgatcaaatcgtatgacagtgacattgacgttatttttatcgctcagggagaccggtatgaggccttgtccgccggccgctgccaagtggtgcgggaagatccgcaatcatatgtgaacgcttttgcggatattcaaaaagagtacggtgaagcttctgccattttgtatttatgggcgcttgaagataaaagctgcatcgaagattattcatgtattgtccatattctcaaagcaatggctgagaccggtctgcagccggaaaggctgttattggcgggggaatatgcatccggtctggaaaggtgctacttggaatcatggatcggctttgagcgttcgctcggcattgttcttccgaaaacaagtgttaccggccacttcagaaaagccggcgcggccataacggactggatgagaaccatttgggacgagctgaaagctgaaacagaccataccgttttcttggaagagagaaaacgatatgtctatcacaccgaaccaaccggactaacgaaagaaaacggcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaagacctggaaaatctcggcgcgggtgttctttacgccgaagccgatgtttgtgatccgatcggaatgggcgactgcatcaagcgcgcgaaagaacgattcggagctattcacggcgtcattcatgcggcgggcatcgaaagcagaacatccgtctttgaaaatgagatcgggaatttccgcagtacgcttgaaccgaaaataaacgggagcctgcttcttgacgagtggctgaaaaacgaaacgcctgatttcatctgctacttttcatccacatctgctgttttaggagatttcggctgctgtgattacgcggtcgcgaacaggttccaaatggcgtatgcccgctataaaaacgaacaatccgaaagcggaaacgcttttgtcataaactggccggtatggaaaaacggcggaatggccgtcggcggtgaagagacgacgggcatgtacctgcaatcaagcggacagcgcctgttagaaacagatgaaggcattgagctgtttgagcgcatcatttctcaagacaacacccagtgccttgtcattgccggcaaaagaagccgcgccgaacgatttttaggcatacggcgggacgattcatcaaaaccggatgcgcttttggaaaccgtgagccgccgcatcccggaagaaagcacggaaaaacggctcgaagcggatttgaaagagctgatacacagtctgctgaaaatatctaaagataaactcgtcctgcataaaaactgggcggaattcggatttgattccatctatttagccaaatttgccgctcttttgtcgagtcattacggcattgaagtcactccggcgttattttacagctatgccacgctcggagacgtcatcagctattacctgacagaacacaaagaaacgatcgaaacgttttaccgaacggaagaaactgaaacaaaagccgccgctccggataacaaggagtacacggatcaggagatcatcgccatgatgaaacaggtctctgaggggacattagattttaaaagagtgcaagacatcatagaagggagtaagacttatgaatcataaagaacttctcgatgcctacagatcaggaacgctcaccatcgctgaagtagaacaaaagcttcagcctttcaagcggacaactgcaaaacgtccgctttctgaaggccagaaaggtttgtggatgcttcagaaaatgtttccggagatgagcgcatataacattccgttatgctttcgttttcaaaagctggatatcgagacattcaaaaacgcccttttgtccgtgcagcgccagcaccctattttgaccagtgtgataaaagaggaaaacggccttccgtatcagatagaagatacggatcggcattttccgattgaagaaatggatctttctgaattaagcgggcgtgacgctctttcgtttattaaagaaaaagcaaaagaaccgttcgcgcttgaaaccgggccgctcctgcgtgttcatgtattccggcgggcgaagcgggagccgattgtgttaatcaccattcaccatattatttttgacggcgtctctcttatgacgtttatgtcggcgctgctggacgcttatgtaaaagcaagtgaaggcaaagaacctgtcatggttcagcaggccgcagattatcatgactttgtgaaatgggaaaaagagctgctggaaagcgaagcgggaaaaacgcatctctcttattggaaaaagcagctggaaggaccgctgccggtgcttgagcttccgtcggattatccgagatcatcggttcaaacttgcaaagggcaggcgtatcagcgcttgcttcctgatgaactgaaccggcagattaaagtgtgcgcccaaaaacataatgtcaatgaatccgttgtgtatctcgctattttcaaagggctgctctatcaatatacgaatcaggaagatgtcatcgtcggcatgccgacgatg

SEQ ID NO: 153 - DNA, 6814 bp, Bacillus velezensis FL50S
cgtaaatgtgcgccatttcctttaccgtacgtgtttctgaaaaacattccgccgtcctgcgcccttcttgtcccattgcttttcgcagacccggggatcggtacagcttttcaatccgatcggcaaatgccgcgctgtcccctgccggcacgagaaaaccgttcacaccgtcttcgatgatctcacggtgccccctgttgtctgcggcaacggcgggcttttcggcagccatcccctcaagcagattcataccgagcccttcgcggatgcttgaggcgacggacagatcagcaagctgaatcagctcatgaatgtcacggcaaaaaccgtaaaaccgcacaatgtcggataccccgagtgattcagccttttttctgtacgcctcttccatcgcgccttctccggcaaatacgagtttcagctccggaatgcggttcttcagcagtgccgcagcctcaatgagaagtccctggtttttattgccgtttaattcagcggggtatatgaggataaattccccggcgccgaagccgtgtttttctctcagacgttcactctctgcccggctcacagggcgaaacctgtctgtattcacgccgatgccgtgtattttcttcgcgccgcaagctgtttttttcatttgcttggcccgttcgtaatcctcttcattaatcgtaatcaaacaatccgtgtaagaagagagaaatttttcgatcgggtaataaagaagccaatttttcaggggcgctccgtcgcagaagtgaaagccgtgcgcggtgtacagcacctttgtccctttttggcgcgcttgtctcgccgcaaggcgtgcaagcacgccgccgaccggcgtatgacagtgaatcatgtcgtagccgttagcctgaatgagccgtttcagccgcctgtaaacagaaagattttcgggatgaaacggcgagcgccggatcttaatggaaaacttttcatcaacgaacggaagattcatattgccgcctgccgcgacgtgcacctcccagcccatatcctgaaaccattgaaaatacggaagatgaaaggctttaaaatgataatcgacagtggcgcagaataatacttttttcgtcatctttctgtcctcccatcacacacctgcggccgcttcttcatgtactgattcgatcgcctcaaacagccgttttctcagctcatcttcaggcagacggctgaattcctccataaaacggatgagcacggcccaatccccgtcgatcgctttcccgatatggattttcggaaaaatctgttccgtatgtacttcattatgattcagcagttcttcatacatcttttctcccgggcggatgccggagaattcaataggaatctgttctgtcgtatagcctgataaatgaatcaggttttttgccaagtcgacgattttgacgggttctcccatatccagaacgaaaatctgccgcccttttgcaagcgcccccgcctgaatgacgagtcttgacgcttcggggatcgtcataaaatatcttgtcatcgccggatgcgtgacggtgacgggtccgcctttttcaatctgctttttgaaaatcggaatgacgctgccgcggcttccgagcacattcccgaaacggacggcggcgaatttggtgttgctgacctttccgaggttcatgatgaccatttccgcaaaccgcttcgtcgcgcccatgacattggccggattgaccgctttgtcagaagaaatcagcacgaatgtttccgttccgcacatatcggcggcttcggcgacatttttcgtgccgataatattgtttttgacggcttcttccggattatgttccattaacggcacatgtttatgggcggccgcatgatagacgacgtgcggctcgtattttttcatcaacgtaaagattttatctctgtcctgaatatcggcgatctccgcgtgaaaaagcacctctttgccgaagcgtgcggacagttcgttatgcaccgaataaatgctgttctccccgtggccgagaaggacgatttcatgcggaagaaacgagctgatctggcggcagatttcagaaccgatagagccgccggcgcccgtgaccagaatcgttttccctttgatgctgtcagaaattttgctcgtatcaagggtgaccggctttctgccgaggagatcttcggctttcacatccctgatgtgtccggcagcctgcgttccgagcaggatctcatcaaattgcggcatgattttaatatgggcgcccgtctgtacacattctttgtacagcgtctggagctcatgggtgcaaagagacggaatggcgatgatgatgtggtgaattctcagcctctgcaccgccggcataatgctttcttttccgccgatgacgggcaggcccatgattttgagcttatgcttcgtctgatcatcatcaataaaagccacaggcatgattccgagatcatttttctgggtaagctgacggacgagcagcgttcctcccgcgcccgcgccgatgatcagcgcccgggaagagtcattttgcttcctgccgatcgtttctttcagcacgcgcgaaatcatccggcttcctccgatgaacaatagctgaaccatccagctgacggctaacagccggaacaaaatcgtgtggaacaccccgtattggacggcggctgtgacagctgcggacagcgtgatccccttcagcagatcaagcagctcgcctattcccgtatacgtccatacctgcttatactggtgaaacataaaagcgcatacatgatggctgatcagcatggtcacggcggtcagcagcaacgctccggagtcataaaagtgataagaatcctcaaaaaattgatatcctataacaacggaaagtaaaacgagatacgtatccaatgcaaaaatcattgaaagtcttctccggtaagtcaatctttcccctcctcatttatcggtttagctgatacggttttcgtaaaaacagacataacagctaagccgataacaatgcatcatcttaagataaattgggcatttaacccgtcctcacaccccgccaccgacgaccagcatctaaggcggcggaaaacgccgcccacagcagagccgagtgcctccgttgataaaggtaaggagacatcacctgcaccgctcaatacgagtagtgctctgtttttttgattttctttttattcagcagcgcccccaaaagctttgcctttgactgctggagcgcgtctttcgccttttggacggtatccattttcgtttttccgctcaagacgacgagaacgcttccatctgtctggttcgctaaaatctggccgtccgccaccgccaaaagcggaggtgaatcgaaaataaccagactgtaccggctgtacatctcctgaatcagctctcccatcgcctttgaagataaaagctcggccggattcggcggcgtcggcccgctcgttaagacgtaaaggttatcaatcagcgttttttgcaccgtttcgccgagggaagcgtttccgactaacacattcgtaaggccttgtacattttcaagctgataggtctcgtgtatcgtcggttttcgtaaatccgcatcgacgagcagcacctttttttcctgctgcgcaaataccgcggcaaggttggcggcgctgaatgactttccttctcccggaacggaggaagtgacgagaatagagcgcaaatgggtctgaacagaggagaactcaatatttgtgcgaatggtgcggtattgttcagccaccaatgatttgtgatgtaaaacggatatttgagccagtccccttcttgatttcttttttctgaatcccaaacgcctcactccccgaaatgtttttcatcagaccgtgtctgctgatttttgatgtcatacacaacccctaaaacaggcaagtctgttttttcgctgagctgccgctcgcttttaacggtttcatcaagaaagtggagaaaaaacgcaagcgtcacacccgccatgagagccgcaccgaacgccatcatgatattcctgatgcgcgaaggcttgaccatcgggctttccgatgcttttgcctcggacaaaacaatgacgccttttatattcatcctgtcacggacttcttttttaaatgtcttcatcagcgtgttcgctatagcggcggcctgtttcgggttctcgtcctgcaccgctgcgttaatgatctctgaatcggtttcgctgcttgtcgtgatctttgcttttaaagcggatgccgtctcagaaagatgcagcttctgtttcactttctcaagcacaaccgggcttttcattatcgtttgaaacgtattgttgtaatgaagattcagctgaacgtcgctgagattcgaatttttttcaccgcttgtttcatgaatgagcacttgggtcgatgcctgataaacgggcgaaatcacccggaattggatgtatcccgtcaccagcgttacaactgctgtcatgataaaaatcagtaaaaatctgtgtttaataatgtcaaataactctttaaaactcatattctcattcatgtaattacagcctcatccttattgcatcaggcttaaacgcccccttctgttaatgattggattataaaagaaaaggtcgaaatttgaaaatttcaaattaagccatttagttctttttagagaacattatcatgattttcctcttatttactgcacttcccttataattttaaattttataaagaacgaaaaatttcttataatgaacaaaaaaatgccagtatacaggggagaattcagcacaatgattggaagaataattcgtttataccgcagaagaaaaggctactctattaatcagctagcagttgaagcaggtgtctctaaatcttatttaagcaagatagaacggggggttcactcaaatccgtccatccaatttctgaaaaaagtatccgccaccctgcaggtcgatctgacggagctttttgatgccgaaacgatgctgcatcacatgggaggcacggaagatgagtggcgcatccaccttgtgcaggccgtgcagtcgggcatgccgaaagaagaactgttcacctttacgaacaaactgactgaaaagcgcccggagcccgcaccctaccgcaacagaaaactgactgaatccaacattgaagaatggaaagcgctgatgcaggaagcaaaagaactcggcttgtccgttcaggaagtcagatcatttttagaacggaagcgttactgatgatatgctgatgaaagggcttttattcgcttcatgccttcatctctgtttataatgaaaagaaaaaaggggatgaaatcatgacaaaacttaccgttcaaacccgctgcggcgcactgaaaggaactgccggccgcggtgcccgcacatggaagggcataccgtacgcgaagccgcccgtcggagagctgagatttaaagcgccggagccgcccgcaccttgggacggcataaaacatgccgattcgttcgggccgatttgtccgcagccggatgatatgctgtccatatcgttttccggagatataccgcctcaatctgaagattgcctttacctcaacgttttcgcccccgattcagagggcgaaaaaaagcctgtcatggtatggatacacggcggggcattttatttaggtgccggaagcgaaccgctttacgacggatctgcccttgccgctgacggagatgtcattgtcgtgacactcaattacaggctcggaccgttaggctttttacatttgtcttctattcatgacgcgtattccgccaatatcgggctgctcgatcagatcgccgcgctgcgctgggtgagggacaatatctccgaatttggaggagacccggataacgttacgatatttggtgaatcggcaggcggcatgagcatcgctgcgcttatggcaatgcctgacgcaaaaggcctgtttcataaagccattttagaaagcggcgcctctcatacgatgccggcggatatggcaaaagacatcgcggcggcatttattcatgaagccggcactgatcaattgcaggagctttccgttaatgacctgcttaagactgcggataaagtgcggcgctcactggatcaaaacatttttcagcttttgtttcagcccgccatcgatccggccacattgcctgcggaaccggtgaaagccatagcagacggggccgcagaaggcatacctatgatcatcggaaccaatcgtgatgaagcatatttgtttttcacccctgatacagacattcactccgagaaaaagcagcaagattatttgcattatcacctcggagaaaactgcaccgagcaagcggcagatttatatccgcattcattaaagggacaaatcgatatgatgacggatctgattttctggcggccggctgtcgctttcgcacaaggacagtcgcaacacgcaccggtctggatgtaccgctttgattggcatggcgaaacaccgccgtttcataaagccgttcacgctctggaattgccgtttgtgttcggaaactttgattctttgagaaagacgctgcaagagccgctcggtgatgacgcagaacagctttccaaacaaattcaatccgcatggctcgcttttgcaaaaaccggaaacccgaacacctctcacttcaattggcctgaatatgaaaccgattcacgcgaaactttgctttttaacacggataccgctgtcgaaagtgatcccgattcagcaaaacgccgcatcctgtttcaagcataaaaaacgccaagggagccggctcccttggcgttt

SEQ ID NO: 154 - DNA, 6520 bp, Bacillus velezensis FL50S
ccgctgtttgatgtcatgtttacttttgagagtaaggattacggattcggaggaaatgaagagacagcagaatcaaatttactagtatctgaggtcaatatatcaagatttgatttaacgttaactgcaatggaaaccgatgaaggcgttaacttccaattggaatattgcaatcatttattcaggaaagacacagtcgaaagaatgggtgctcattatacccggcttttacaacaggttgtatcagaaccggacacggcaatctgcagactgaatatgataacggatgatgagaaacataaactgctttatgtattcaatgatacagcagccgacttcccgcataataagacaatccatcaattgtttgaagaacaagcggaaaagacaccggaaagaatagcggcagtgtatgaaaataataaagtaacttataaagaacttaacgaaagatcaaatagtctggcgagaatactaatgaaaatgggggtgaaaaaagagtcaatagtaggtattgttgctgacaaatcattagagatggtgttaggcatattgggtgtgctgaaggcgggaggcgcatttttgccaattgatccgggatatccttctgagagaatcaaatacatgattgaagacagcggttctgacattttattagtgcagaatagtcaggctgacaatattccgtttgacgggaaggttattgatttaacagatagttctctttacaccggagatcggcataacctgccaatgatgagttccgcagaacatcttgcttatgtcatttatacttctggaacgactggaaaaccaaagggtgtaacgatccggcatatcggaatcagtaatctcaaaagtgtctttgaacatgatatgaatatcaattaccgggataaaattattcaatttgcaagtttttcatttgatgcatcagtgtgggaaatcagtatggcactgttgaccggagcggaactacacatcctttcaagtcaagtcatcaataattatacattatttgaagagtatattaaccggcatgacattactgtagccactttgccgcctgtatacatcaaccatataaatataaacggattatcagctttaaggctcttaattactgctggttctcagatatctacaaaatccttgaaccggatcgtgaataaaatagactatattaatgcctacggtccaactgaaacgacaatctgctctacaatgtggagatactcagaagctgagagggcgatggcaaagaccattcctatcggtaagccgatcagaaatctgaaagccttcataattgatcacaacaacaatcttgtgcctattggtttagcgggagaattgtgtgtgtcgggtgacagcttagcaagaggatatctcaataaagagaaaatgacgcgtgagaagtttattgatcatccatttgagtccggaactaaaatgtaccgaacaggagacttggcaaggtggcttcctgacggaaacatagaatttttggggagaattgataatcaagtcaaaatcagaggcttccggattgaaactgatgaaatagaaagccagcttctgaaaataagcgggataaaagaagcagttgttatagataagtgcgaccttcacggtgacaaatacctttctgcatttgtaaccgcagaatataaaatatccggagcagctttgagggagcaattgggtgacattttgccgcaatatatgattcccggtgtcatcatccaggttgaacagctgcctctcacaccaaatgggaaaattgacaggaaagcacttgcagaaatagaagagcctaaacatataaaggagcaccttgaagcaccccgttccgaagtcgaacagattctggtaaatgtttggtcggaagttctgaaaattgatgatattggtattaatgataattactatgagctgggcggagactcaataaaatctatactgattgtatcaaagcttcaaaaatacagtctcagtctagaggtaaaagatcttttgcagtatccgcaaataaaaaacctcagtaaacacgtgaaattatataaagctcaaacagatcagagcccggttagcgggagaactgaactggcaccgatacaaaagtggtttatagagaatgactttgcggacattcaccactttaatcaggcattcatgtttcaagtgaaagaaaaaattaatgaacacgctctggcaaagacatttgaattattagtaaagcatcatgatgctttgaggttgatatatacagccgaaaatgacgaaataaaacaagaagtcagagatgtccaagccgcccgggatacttttactctggacatatatgatctgcttgctgatacggattacaaaaatacaatagaaaaacttgccgatcagttacaaagcggaatggatcttgaaaaaggacttttaatgaaacttggtttatttcgaacaatgaggggcgattatctacttattgctatacatcatatggtgattgacggagtctcttggagaattctgcttgaagatatggagcaggtctacaacaatctgcaaaaaggagagccggccgttcttccgccaaaaacggcatcctttcaagaatggacacgtaaattggcggaatatgcaaacggaagtgagataagaagggaacttcggtattgggagaatatcgagaaaacgaagattaaagaaattccgagagatttcaataaaactgacagtgtatttaaggaaagccgcaccattactgtcagtcttacaaagcagttaactgataagctccagaggaatacaaatgcagcttataacacacagattaatgacatcttgctttgttcactgggaatggcagtaaaagaatgggcgggacttgacaaggttttaatcggtctggaaggccacggaagagagaacatattagaaaatatttcaatagaaagaaccatcggctggttcacctcactatttccgatcgtgctggatatggagcacagtgatgatctgccttattgcataaaaaatacgaaagagtatttaagaagaatacctcataaaggtattggttacggaattattaaatacttgacggcaccggcacataaaaaagacatcagttttacgataaagcccgagatcgggtttaactatctgggagaaatctctcaaaaaaagcgggctgtttttcagcatgcagatatatcatctggtacaagtgtttctttatctaataaaaaattgaatgccatcgaaatcaacagctttattatggacggtcaactgcagttggaatttaactatagtacgaaagagtttaaagaagaaacaattaaaacattaaccgaatcctatataaaccggttaatcgatattattcagcattgcggaatgaaaaaaattcctgaaaaaacaccctttgactatggagatctggatttatccatcggagatttggagcagattttatcaagcggaaaagagatagagaaaatccactccctgactcctatgcagagcgggatgctttatcatgcattgcttgatccgttttcacaagcctattttgagcagcttacattttctttatccggtcagcttgatattggcagattaaatacagcttttaatatgctgatcgagaagtatgaaattttaagaacatgcttttttcatgaaggactaagtaagtttaaacaggctgttctaagagagagaaaagttaaaattgaatttgaagatatcagcactttctcggaatatcaaaagaaagtccggcttaaaaatgtccagtttaaagacaggggaacgagattcgatttgacgaatgattgcttaataagagtaaccgtattaaaaactgatgagaaagaatataaactgctgttcagttttcaccatattattatggatggctggtgtatgagtttaataatgaatgatataaaaactatttatacgtcattaaaagaaggaagagagacagtgcttcagcataccgagccttacagcacctacttagaatggctggataatcaggacaaaagtgccgcattagaatattggggggattatctaaatgaatatgagcagcaagccggtattccaaagttctgctgatgagggcggtttcaataataggaagaaaacattcattattgatgaaacatgtacttcgatgttgaaagctgcagctgatcaatatcacattactttaagtgcattgattcagactgcatggggagttcttttgcagaagtataacaacgtggatgatgttgtttttggtgcggttatttccggaagacaatgcagagtgcaaggcatagaaaaaatggtggggttatttatcaatgcggttcctctgagagtaaaaggcgatggtgatacggtatttatagcattagcccaaaagctgaacagtgactttatcaaagcgaatacatcatacggttacagttctttagcggatatacaagctcttacaaagatgaaagagaaactgatcaaccatatgttggtttatgaaaattatcctgttgatgactatggcaaggcggtcgataatacaactgatgctttaaggattacagatatggaagtgtttgaacagacgaactatgactttgggctggttattattccaggcagccaaatcaaagcagagatgacgtataacaataatgtttatcgtgaagatatcattaatcgtataggtgttaatttctgtcatgtattaaagcaagtggcaactgatcctacgcgtgtcctgaaagacatcagcgctgtaaatgaagaagagcgcggaatgctccaggattttaataagcagtcctctaattatacggtgaataaaacgatacaagacctttttgaagaacgagcggaaaagacacctgaccaaacagcggctgtctatgcaggaaagcatatcacttataaagagctaaacgaaaaggcaaatcaagttgcaacattattaatggaaaaaggggcaggaaaaaacagcattacggctatgatgatccgtccttcagaatattcaatgattgggatgctgggaattttaaaaaccggaagtgcgtttctgcctattgatgatgaatcaccggtcagtcggataaatcatattttaaaagatagcaaagctgatatcctcattacagatttgtgctttttagctgataaaaacattgcggcggaatgtttggatattacggataaatcgatttataccagccaaaatacatcaaaccctgatgttcagtatgatctcgaggacgaggtatatgttatatatacctcgggtacttcgggaaaaccgaagggggtgaaggtgaaaaataaatcattagttaattattcattatgggtatgtgatcaaataaacataaattctgacagcaggtcgttagtgacgtcaaaatatagttttgacttatgctataccagtatatttccagttttatccggtggcggacaagtccactttgttgataaagaagtgtatcttcactctctatcattaatagaatatattcataaaaatagtattacatatcttaaaatgacacccactttattttcaacattgatggaggatgttgacatgctggcgtcttgtcctgatttaaaagttattatactgggcggcgaaagcataaacatcggcaacgtcaaaaagctcgctgaaaaatgcagatggatgaagtttattaaccattacgggccgaccgaaagcactgttggctgtattgcacatagcattgatctagaacatattcaaaactgtgaaatatacaatagaataggaagaccaattcacggtattaatatctatattgtggatcgttcagatcaactggtccctgtgggagcacctggtgagatttgtatcagcggggtaggtttagcatcgggatatgtcaataatgaagaattaacgaatgaaaaatttattgataatccttttcattgtggagcaaaaatgtacaaaacaggagaccttggcagatggatgccggatggaaatatagaatttttaggccggattgacaaccagatcaaaattaggggttttagagttgaaatcggagagatcgaaaaccaactattacagctggaaggtataaaagaagcggcggttgtttatatagaggagaaatatctttctgcatatattactggggacattgagatggaaggctcgttcgtacaggagaaattggcacaggttcttccgaagtatatgattccgagtttcataatacaactgaaagagttgcctcttacagctaacggaaaaatcaatcgaaaagagctgcctcttcctgacttgcaacggttgtcagtacctcaatacgaagctccggcaaatgaaacggaagaaaaactagctgaaatttggaaagaaatgcttgggcataaacggatcagtataaatgaagatttcttcgaactgggcggacattctttaacagctgcgttcactatttcccgcatcagaaaaaca

SEQ ID NO: 155 - DNA, 6466 bp, Bacillus velezensis FL50S
ccgcaatccgctgcatgcgcttatcaagtgttgtataaacacgcaatccgctcgttgcgagctgttcgcgcgtcatgccgagctttttctcgagttctttcatcgcatcatcgtaaaaataaggcgccgttttcgccgcggttctgcttttcagcggctgataggcaagcggcgttttcttaatcctttccgccttttcttttgagatcattttttgtccggccatcagacggagaatggtttcctgacgctgtttggccttcttttcactgacatatggcgaatagccggacgggcctttcggtatgcccgccagaagcacggcttccgcatcgttcagatctttggcgtgtttgccgaaatacaggcgggaggcggcttcaattccgtatgcgccgtggccgtaatatatcgtatttacataaccttctaaaatctcgtttttagaatagttctgttcaaggcggatcgtgtaaaatgcttcgttccattttcgtttccatgttttatcatgctcaaggtagagatttctcgcgtattgctgggtgatggtgctggcgccctgaaccttggccattgcctttatgtcagccagcgcggcggcggccatccgccggtaatcaaaaccgtggtgattgtaaaagttttgatcctccaccgcaatcgcggcctgcaccgctgtcggattgatatcttttaaccggacccagtagcgcttttccccgaaatcggtctcacctagctttgagccgtcatttgcataaagaatcgtagactgaggaacccggacggagggggcgccctgccatttcgctgcaagaagaacggatgtgaagcagacgccggccagcattccgccgatcagtgtcagaaagatgcaggcgcggatgattttgaatgtgattctgagctgatttccagatactttatccacttttgggaaccccctttttcatgattctattattatgtgaaaaaagggggttttttaaacatatcaaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacatctgaaaaagacgaattcgtctatcatgaaatggttgcgcacgtcccgttatttacgcatccgaatccggaaaacgttctcgttgtcggcggcggagacggcggtgtcatcagagagattctgaagcacccaagcgtaaaaaaagcgacgcttgtcgacattgacggcaaggttattgaatactctaaaaaattccttccgtccattgcgggcaagcttgatgatccgcgcgttgatgtgagagtcgatgacggtttcatgcacatcgcgaaatcagaaaatgagtatgacgttatcatggttgattcaacagaaccggtcggaccggccgtcaatctgttctcaaaaggcttctatgccggaatttccaaggcgttaaaagaagacggcatcttcgtcgcgcagacggacaacccgtggtttacaccggagctgattacaaacgtacagcgtgacgtgaaagaaatcttcccgatcacccgtctgtatacggctaatatcccgacgtacccgagcggcctgtggacatttacgatcggttctaaaaagtacgatccgtttgaagtggaggacagccgtttcttcgacatcgacacgaagtattacacgaaagagcttcacaaagcggcatttgttcttccgaaatttgtgagcgacttaatcaaataaaaacgtacggcgcaggagcgaatcttgcgcttttttacaggaaagcgaggatattattgatgagatttgatgaagcatattcaggaaaagtatttatcgcgagccgccccgactggaaagaggcggacgccatcctttacggcatgccgatggattggacggtcagctaccgtccgggttcacggttcggcccggggagaatccgcgaggtgtctatcggtcttgaagaatacagcccgtacctcgaccgtgacttggctgatttgaatttctttgacgccggagacattccgcttccgttcggcaatccgcaaagaagccttgatatgattgaagaatacgtggacggcatcctagaaaaaggcaagttcccgctcggcatgggaggggagcaccttgtatcatggcctgtcataaaagccatgtataagaagtttccggatcttgccatcattcattttgacgcgcacaccgacctgcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgctgaaaaaagtgctgccgcagcttgcgggacgcccggtttatgtcacgatcgatatcgacgttcttgaccccgctcatgcgccgggaacgggcacggttgacgcgggaggcatcacgtctaaagaattgctcgcgtccatccatgaaatcgcgcgctcagaggtcagcgtaaaaggcgccgacctcgtagaagtggcaccggtctatgaccactcagaacaaaccgcaaacacggcaagcaagatgatccgtgaaatgctgcttgggtttgtgaaatagaaagaatttcccccgcttgaaacatggcgggggatttttatattgtatataaactacttagaagttagtaaaagaaatatattattttactattaataattgatgttattgataaaaattatataatagggtattatttagtaaatacatctttagaaaggaagttagaatgaaaacagcagtagaaaatgaattggaattaaaaaagattgaaatttcagtaattaaactgataattgctgaaaagcctaataaagagatcgctaagtcattaaactactcgcagcgtaatgtcgaatatatcatagccggtctttgtaaaaagtggaatgtaagtactagagtcggtattgtttcggaagcatataaaaggaattgtatacagtgaacgaaaaaacccctattgagggggtttattatatatgctaaaaaaacattctatacaggaatgccgtaaaaataaaaactgagattgtcaggtagttcaaatttgttctccatttcagaagaataaacaaaagaaataagtatgcaatattgaacaaatcaaagatagaaaaaatcaaatgattacttgtgaaaaataaactagtgtttggatgttctgcgaaaatatttttgaatgatataagaaaaaacttaatcgcgaccgggatgttagaaaacataaatagggaataaaaagttttgatcttaatctgagcgccaagaaaatttataatgagaaataatacgaatccttcaaaaatgaccccgaacattaaaagaaacagtgcggctattgcaatgatgtaatctaaatgttttacttgctcaacaacttgtatagggatgtttttgggaattaaacttttcataaaaggtaaaagggaacttaaataaaaagctaacccgataatataaaacaaaaacgaggacaaaaaattaatgtttcgttccttaaatgaagataattcaatttgcataatcctaagaggctccttttataaagataggtgtaataaatgtttctaacatagctgctatcattaaaccgagaaatataataccaatatatttaaaagtgaatttcaaatttattttgaggagtaataaatctaaagttaatttcattcctacagaggctgcaagaagcaataccggcacttcaattattccatggggtataacaagcagtaaaaggtttaaattgtctttaatgtttcctatcgcatttcctaaaattaatccattaataattaaaacagcaaccgtgccaagcgacagcgttaacgggcctaaaaaaacaagcagactcgctactttaatattattaaagaaaatctgaaaaaaatccggacggatatttcgatttagattatttacatttgaagcggaatctgtataaatatatgctgtaaataaagcaattaaaaataagatcagacagagtatgtacaatttgactaaaacattctttttaaacaatgtattttcatccattcgttaaagggactgccagggatattgaatttaatgttttatattatgctgctgctgtacttgctgcagccaattgttctaaaacggccaatggcaagcctgcaccaagagatcctaaaacagtaatgatagccagaactgatcccgttgcggtgatagcactgacaatccaactaggagcgataattccagctctgtttaaaatatcgataacatccatgcttaaatgattatgtttcatactgaaaagagcgagaacaatgattcctgatgctactaatgtaaaaatcgctttactattttgtgtttttaaaagtagattcattttttcctccaattttttcaatatccccagcaagttaaataataaaatatattggaatctatttgaattgcggatttccgaaaaaataatagttaagaggtgaaatccgtaaaagtatctgctggcttatttcgtacaaagaaagccggaccctatgtatgatccggctttctttggtactgaaacattatacttttttttcaaaaataatatcaaaataatcagctgccccatagcctgaaatagcaggagcaaatatttgaaccagctttcacccttgctgcgaatacttttcaataatttatttatagtcttctttaggctttcctttccatcggtttacttctgcttttatgaacttgtattcgtacattgctgtataatcctccggaagtgtattggaatcgttaccttgtttttcgattttgataaacttgaatccataaatagagcgcgcagcctattaaaagaatcggaaattgccatcctgtatttccgtttttaaaataatctattaatgaccatatcagtaaaacgacagtataaaaactaaatgctattctggcggctgtacccgattggtgtttttgcatctcatccattttcttcataagaaccgctcccttaattttttttggcgttatagttgaatactttatctattcccgtatttaaagcgtgagctatcgaaaaagccagacttaaagtcgggtcatatttattattttcaattgcattgatggtttgcctggtcacattgcagagcttagccagatcattttgtgaaatatcagctgctgttctaagtttttttatattgttatccactaaaaccctccttaacttattttgttttttattttaaattttcaaatttatatatatttattttaaataatatatgtataagtgtcaaatactttttacacatttgagttctaaggtatgttttttgtttttgtaaattagttgtttatataaaaaacggcttgcagtttaacctgcaagcctaaaagtaattatcatttaaatcatagctctttgtgctacttcgaattggtgtgaaggtgtattcgtcatatctgctgttataaaaactgaggttacagctaagcaagtgagtaagaccttatacttcagcttcataaaaagttacccccccttgaatatgctgtcttgcttcttcaacttttaaaaagtatgttgaagcttttttataatcttcaagtttgtgataatatttagctgcatcaagagcaaaatcttctatatctgcatacatcatcttactttccaaaaagtcaaaactccttttcattgcatcctcatcaggtccgttcacatacaaagattttaaaaattcgaattcatgtaaataaactgaatctgctgactcttcggaatagataactccttttttatgatactcgagcgctttgtcgtatctttctaatttataatgaatctgtgtcattaaaaaatatgcttggggcaaagaaggggtcattttagcactttcaaaaacatcaatggctttttcaacataagttatagctgcttcatagtcgttcaggctttgtttgcaaagtgcgatgttatacagcgtcctgcccattaattgaggctgtttttctgtttctgccaaagaaaaagccttttgaaagtgagtaattgcccgatcatatagttttaaatccaggaaatttgctccgaataaggattggcattgtatgagcctgatatcgtatgccgtcttctgcttg

SEQ ID NO: 156 - DNA, 6185 bp, Bacillus velezensis FL50S
agccacttcatatgaagtggctcttcttaatggtgatgggtctgtatcgaaaacgatcaagctgctgtacgatttcatcgctggtgacacacttgtaattgattctgcaaaaagaaaagtcacttgcagcggtaatttaatcatgacagcacttcaaattcaatcagattggtttctgctgccgcctaggacgccagttaaaatcaagttcagtcataagagcagcatcaaatttaatgaggcatatttgtaaggaggtccggtcatggctgacatttatatactttcaccagatgataaattattgacagtgctgtccagccacggacgagaaacctgtacgttctgggatgctaaatacaaagaagagctcaacaagggatcttctttttcttttgtagccgatgcctcccaccctgatgcgcgcttcctattcgaagagaatcaagtggtattcaaggataaggacggtgtaatgcgtctgtttgtcatcaaggaactggatgatgcaagtgaagaaggagagattaatactcaggttacctgtgaagctgccatgatggagcttgccgaaacctttgtaaaagattttcgccctaccaataaaactgcccagtttgtactggacaacgttctttctcggtcaagatgggtggcggaagtaacggcggagcttggagtgaattcgactaccttctataagaaaacagctctggattgtatagcggacgtgattaatatatgggacggtgagcttcaggatactatagaatttgacgggaacaaggtcatcaaacgaatcataaagatacttccccgtcgcggtaaagacagcggtaagcgctttgagagtgataaggatacaacaaatatccggcggactgttatcagttacccggtgacagccctttggggttacggggcatccatagcatctacggatgaggaaggagaggaaacgggcggttattcccgttttattgatttctctgaagtagaatggaaaaaatcaaaaggcgacccggtcgataagcctttaggccaggaatgggttggcgatccggatttattagaacgattggggcgccttaaagatggaaagctgatccatcgggaaggccagttcaataatgaagacataacagatccggtagagctcttaaaggccacatataatcatttgattacgactgcatgtaagacagaaatcaattacgaactgtccgtgcaactgctcgagagcgtgccgggacacgaacacgaacatgtggaattgggagatacaacgatcgcaattgaccgaaacttcgctattccaatcgagacatcgcagcgcgttatttcaatggaatacgatattaccgaccctgaaaacacttgcgtcgttgagatcggccaatttttatcggcattacaaaaagacggtaggcttgagcagattgaaagtgtgatcgaaaagaaccgtggcacttgggaaagcaaaccggacgccggagaggttacggacggcagctttcccgacaaagcaccgcccgttccgtcgaatgtagtgatcaaacccatgtttcagaatgtggccctgacatgggactatgatccgtccagttatattgcagcctacgaggtgtatgcttcacaagtaaatggattcaccccattaaaagagaatcgtattttcagaggcaaaacaggcggatacgagcattttacgggagtaaatgaagtttggtattatcgcttgcgctcaatcaacacacggggcacagcaagcgaattcacggatcagttctccgcgaccactcagcgcattcggactgatgacattgttttcggagcgatcacaaaagaaaaactggcccagctggccgtcgatgctgataaactttccagaaactttgatgatgctaatatcttacccggctctcttttaaaatctaaatggttctatgattatacggacaccagccacagtgttgaggaaaaagaatttaatgaaatgactgtttctcaaattatcaatggaacaactagaatagctttcggaatatgcgggaacaggtcctcgcctgttaatattcaaagaatggcattggtcaaagatcaacaatatacactgtcatttgaaataaaacggaataataccaccgacataagttatatccatttgaaaaaaggcagcactttcatacaaattagcagcgatgaacagaaagatatttctgcttttccatctgaccaatttataagagttaatatcaaatttactgctccggaaaccggctctgattacacaattggaattggcggatataaccgaaacggaaacacggagccttgtagctttgttatccgtaaggtacaggtgcgcaaaggcgatgtcatttctgattatggttatagcccgtttgatactcagctggttgatggtgttattgatggcgaccacctccaaaaggcggtaatagaaacagctcatataaaaaatgcagccataacaagtgcgaaagttgctgaagcggctatcgggacagcggctattcaaaatgcggctatcgcaaaggcgcatctaaaagaagcaataattgattcggtacacatcattgacggttcaataacaaacgccaagatccaagacctttcagcggacaaaataaacgtcgggacgttaaaaggtatcacaatagagggtgtggacataaaaggggcccgtttcgaggcgctgacacaatcagaagatgccgaatactatatcgaaggtgataagatttaccaattcaccagagactctcattatgattacaacaaattggttgttagttctgcgaaaataacgcaggaacaaggaaggttttacgatcctggtaattcctataatgaaatctacagaacagtctcaattggtgatggcaaaattgagctccgtggcgcaggcgagcaaaccgcatatgaaacggttccaactatttcaatgtattcagaaataggagatgttggacaagttataagccattttaatatgaaaatggaaagacaggcagctgttgaagaagacgcttttcttcttactgctactaccaatcctaaaaatataggagagccgttcacatataaccgttatcaggccctttttgaaggatcagctactatttatcgctttaaaccgaataatttagatattgatgtccccggggtcattcgactgaaatcaggccaaaaaacgattgttgatgcatcagatttaacgctaccactgggaaccaaagttgtagcagggaatgcaaaaaattgcgaattcaaattgatgggtggcaatgtttctacagaattagaagacgagcatggaggcctacaatacggtttgatggtttactgctttacttgggacattaaactgccgcctgacggaggggcaactgcgtacgcgcgctacaatcgcattccttttgttgatagtttttattatgcgcctgagaacgtttttgcggcggtaggtacagccattggcgcatattctaatgcggttacggtgggattagaaaatataagcgccagttctgttgatattggagtgagagggactgggactactgccggagttgcgggaaaaacgataaaggttcaaattgttattttttacgaatcacaataaaggagtaatttttatgattgaaaaaagggattttaacatgagtctttattatgcggacggcatcgaaatagaagaaaccagcgcgggaatcgaaataactgccggctctataaaaaaaggagtcaagatatatcccatggaggctgtttcgttcgatctgcagccggacgatacaacaaaagtagcgtatcaattatatgtccttcatgatataaagtctgatgaaataagctatttgctcacaaaaacttatgtagagcctgacggttattatcaagggtacagtgggagcaaaaagcttattatgattccagttcaaattgtcgttgatccacaaggcaaccgagaagggcttataacaatctacgttcaaaataaggaggatggcaaagatgaagcttgagcccgtggtattaaatattgaagcaaaagatagagaaaaggaaaagactacagaggaaaagttgcaggagcaagtccttgaccttcagcgggtttgcaatctcttaatgaatcaataaaaggaaacggggggagcccattggagaaccgaagtgctcttttcgggttttttgaggattgctggaaaaacggaactattttgaccgttgaaatgagaaaagccgttgagaaaggccgcatcacacaagcggaatatgatgatattacagaaagcgaacgcggtaatgcgtatcccgatcaagagtaaggagtgaaaggcatgcaagaaatgacaaaagagcaactacaggaccagttacaaattgcagcatataaagctgcttccctacagcaggaattgaatctgaagaataatgagctggccgaatataaagcgctatacacctttgcagataataaacgcgaggaccttcaagaacaattaaatgctgcactgtcagcgaaagaaaataatagtgaaccagcacctgtaaccgaataggtgtttttattttgcctcgaaggaggtgatcaaaatggagggaatacatgtgtggatgaattttgaaagcttacagatcgcaagaacatatcttttcggggaggtgaaataccttgacttgcttctgatcctcagcatcttggatgtcatcaccggaattatcaaagcgtggaaaatgaagcagcttcggagccgcagtgcatggtttggatatgtccggaagatgctcagttttatggtggttatcgtcgcaaacattattgatacgataacaaatttgaacggtgttctgacctttggaaccgttcttttttatatcgcaaatgagggcctgtccatcacggaaaatttggcgcagatcggggttaaaataccagccgttatcaccgacaggcttcatgtaattgaaagcgacaacgatcagaaaacagaaaaagacgatcaggcagctggttaatccggctgcttttttttgaatccaaaaacagaataggagagatttttatgtcagcatacagaaaccaatatattgatattaacaaatggacgcggccgggaatcaaaaacaacggcgtgaagaaactggtggtgcattacacggcaaaccccggcgcgcccgctgccaatcattatagatactttggtcaaacgctccccgcacagaacagaaatctgtctgagaagaaacagacgtttgcatctgcacatatctttgtcgatcgtacagaggctatttgcatcattccgttgaatgaggtggcctatcatgcgaatgacgttcagcaattcgtcaacgggcagccttaccggggtgtcgcggcgctgaaaccgaatgcgaatttcttatctataggcgtggagctttgcattgaaaaggacggaactttccatcctgataccattgcccgcgcagaacaagtttgtgccgagctatgcaaaatgtataaactcaatccgatcaatgacattgttcgacattacgacattacacataaaatttgcccggcgccgtgggtaagcaactctaaagggtttgccaattttaagagccgtgtcgaaaagcgaatggatggtgtggttgtaacggcgcctgaatcaaatccggatgttacccatacagacacaggaagattcatcaaaaacacggtggtttcaagcgatggccttgttctacgtacacaacggagcgcctcttcttccatggtgcttaacctgccgaatggcacggttgtaaaatatcagcttggatcaactgtcaacggatggggatatgttgaatacaccaattcaaaaggccagacattccacggatatgtgaatgtctcctatatcaaaagcgataacgagctgaaaagcggcggcaagaagaaagcaacatcgtcaaagcctaaatccactcaaaagtcaaaattcagcttgcctgcgggtacttttaaagtcacaagcccattgacccgaggggaggccgtaaaacggattcagacagcgctggcggctcttcattattacccggataagaatgcaaagaatttcggaatcgacggcgcatatggggcgaaaacagcaaatgcggtcaaacggttccagtccatg

SEQ ID NO: 157 - DNA, 5339 bp, Bacillus velezensis FL50S
ctttcatgaccatatcctttcttttaagaagcttcaacaaaatattaccatggaagaatgaagaaaatgattgctgtacgattgaaaaggaaaaaatgaatcatttggtctgcgtctttattccttgtgttgctcttgaatagagataagagaaagcagatttgaaatggttgggtaaaaatggctatcggacatctatctctttagggtgctttttttatgaaatatattggtgtttcggataaaaatggtataattcttgtgttaggaggtggttaagtggatgagtttagaaactgggtactttccattgcggggattgtcacaatatgcaaacagctttatgacatcttccaaaatgaaaagaagcagcgaggagagaaaaagaaaaagcgcttccgccggcaaagctagaagcgcaactgcaggtttcaaggttttcaaggggggaaaccccctgtttcctcgaatatacactcagtatacattaaaagtgattgcggtatgccgcaaaaacgtattgcggtatactgtaactcatccactttcgaatgaaagattatctcagcaagtacagtacatcagaaatggccatgcttctaataatgttatttggacttgtagctattgattctaaaaacttatcgctttcgggaatgatagcgagtgtaattttatatctggctgtgatcctcacaattttcaaaggtcttattatgatttggtcagaaaaacgacatgaaagaaagcgaaaaaattaagtttatccaagactgtagcggaagcgagggatctgcttggagtcacccggcagcgtttaagcacccttatgacagccgggaagctccagccgattaaaagttggaacagttgcattgtttttacttggacatgtacaagcactgaaaaaaagattggaagtcgcccggaaaaagtaccggacgtaggatgattgaagtttttgtcatacttttctttactataagtaaagagagatttaaacgaaaagatggaactgctgtaaattttttgttaatattgaataagaaaaccccatcattaagatggggcgagcacttaactttagacaacttgatactaccattgtttactgttcaagtatagtttagtgctctttattattggatatagtgaagggcaggtctatatgcagaaatatttaaatatagttgaaaagagcacaattttaaatcaatttgcaaaaacaaaaaaagttaagttttttaaccgtgacgctgttgaaattattgacgagctttctgaaaaaggctaccgggatgatttgagatatttagatgagcaatttaagttttcaagtaagcatttgacgttgtgtgaacttgaagacccctttcctgagacttcaaatactccagaaaaactgttgaaattcttagttgggaaaagaggacttagaacaaatcaaattgatacggagtgggagccagaccttagaccaaaattacaattgtgtgcaattaaacatgaaggaagtgccgtctacttaaaatttgtagaagaaaaaagctcaactcgaaaaaaaggatacggttctatgaaagtctcttatgctcattttatctctattgttgtaatatttgctgataagcctctattgcaaatgagatgtgcttttaaagatatagttaaatatagaaaacaagtgttagaatttataggttattcaaaagactgtaatcactttaccgttccgaaattgacaaaggaaaacgcaaaaagaatgtgtgatcatctttcggcaggtgtttcttccagtcacattgcacttcctactagtgtaggaagcattcaatttaacggtaaaagaggcgttgatttaaatagtgataaaacctttaacataattactactgcaataaatgagcttggttatccaacagatcataaaatggacgagaagtgtattttcaaatatactgatccaaggacttccgtagaaatagaaaccacttttgaagttaattatggaaagggctattttaagtttgccaaggaagtacctgagactgttgttgatcatgttttagatgttttagttaaggttgatatggaagataaaaaaatggcttctataattgaggcggcgtctactgcggaaactatagaaaaagacatatcgattaattagtaaaaaactattggagggggaattatgagcacagtatattttgaagatattaatagtgtattatcaaagtgggctgcaaatgatcctccaatagaagatttcactgttgaaaatgttctattcgctatcggagtaaataacgattcttatgatcttgtactaagatatttaatgagtaaaaaggattttgaattaatacctaaaaaaatgcttttgtgtccaaataatcataaggttcgatcttttgatttggaagagaacattgaggattattttgactgtatttgtggtgaaatagactttgttccagagccagagaacttcttgttagtctttgaattcactgattattttatatctcaatgtcaaaaaaaaaagaaaccgcccagcttgaacgaaaactggagcgggaggctccagttagtctaacagataaagaaaaaactatggaagaactgatagctaacggacaatttgaagagaaaatgaaaggggtttacatctacgtggataaaacaattcataatacagttcataacccaaatggaactgcaattagttttggttcgcattctaataacacagtggtgaataacaacaatcagggagatactgaattcgaggaagtaactaaattacttcttgctgagataaaaaattcagaattgaatcctgaaaagcaagaagaattaaatgaacttgtggacgcagctaattctgagataactgctgaaaaaccaaagaaagcagtcttgaaaagttttatagattcagcagattcaataattaagactgcttctaactcagtgaatttaatttcggcttttgaaaaatggcaaaattttttctcttaaaaaagcttacttttatgtaagctttttttatgcttttatttagcagtcgaataggcacctattttataaagagactcaaatgtatctcctattaaatcctttgtttaactttattgtaatgtgtcaaaacatccactttttctttagtttatcccactttaaaatgcgctgtctcatcaaattcttcacagcagcacggatcgtctgctcatctttcccggttttccttttcaattgttccatggagggatttttcccgaagcgggtcatgttaaaaataatccgatatactttccgttcaaaatcggtcattgcgattcaactcctgcaaggatgatatacgaacattagttctgttgtcaataaatctaatttggggacagttggggacgaattggggaccaacttgttcatttttagccaaaacagaagattttttatcagaaagactggtcagcaaaccttataaaataaggtttcaaaataaaacgtctgttcgtatcagaagataatcactaccttgacagggtagaggtcgctggttcgagcccagtcggaatcatagccaaaacccttgcgcagcaagggttttttactttctcttaatatagccggtttatcaaattcgcaagttgttggcaaactgttggcgaacttgattttttggctcgaaatttattgttcgtatctcttattagggtcaaaattgttgaaaagttcagctgttgatgccgtcaagtagatccaaaccgcactgtcggtattgcatttctatccggccacaaacttcggtatcaatataaaaaggccctctcataaaatgggggccttcagtgttcttttaaatagcttcttttagttgttctattacacttttcaaccattctataggtggtaagccaattgtcgggaaatatatttctgcattacactttataatgtcttccttttcttctatagttaaatcgctatttagaaactcttcgcaatactttactgtaaatagcagaccttctttactaatttcctcaataaattcgtctaaggcgtgttcaggggattggatatcttgatgaaatgttgcacctaaaaaattttctaattcatctaagaaatcatacctttcatccatgatacttcctctctttctatttggttggatatcctgtaaggataaagttaccgttattatcttttttgagtataatttttgcgtttgtaacgttttctactagatctgaatttcttgatacacttctgccgattatttctccatcgcccttgtatcttaacattaatttaggttttttaggatcatcaatccaattttcgattttctttatattttttggatcgtttaaaactgaattagcaattctttcagcggtagccctatctttaaaagtagatgaagctgtaatatgtgggttaggatcagttttcagtctttctattaattctttatctgttttcccaacatgcctttctagaaggtgtccgccttttgcttcgtgagcagctaagccaccgcctggtgcgagaggactgctgtctccttgtttaacactatgtatgccgttattgtcagaagtcacagatttactgagcacactctctttctgatcttcaataatacttttcaacaaaggcgtattcttcacattgtgagtattttcaatatcctgtgctattccggcaagcgcgggttggtacttatttttcgaaacggaattgatataattttttcctttttcaatcccggtttttacatgttttgcagctgctttttcaccagcttccaagacgttatccactttggcggcgcctgttttcgcgagcttgcttgatacttttacagctgagccggaacctttgagcccgacgatgctcccgatggcgtaagtgatgtaatgggatcttgaatacgcatccccgttaaccattttatcattccacgaatccgccaggtttgtccatatgatttttgcgtaggagggcgtgttcaatacagccgatatggttttagcgactttttgttcatcggagagatggtaaaaatcccatgcgccgacagccagatctttgacgccggttatggtgtcttttcccacatcataaaggccgacgcctattcctttgacgatatcccaagccgtttctccgacttcttcaagctgttttgcttgttcaagctgcattacatattccacctgagcgggttcaaggttttcatagccgatcttctttgcgatttccaaatactcatccggatcggtgacaccatcagccagctttttcttcagatccttgatttc

SEQ ID NO: 158 - DNA, 5219 bp, Bacillus velezensis FL50S
acggttccagtccatgtatggcctagctgctgacggtatttatggaccaaaaactaaagtgaagcttgaggcgctattgaggtaaataactctttccgattatttaaccccgtattatgattttgaaaaaacagacagtcaggactatcccgactgtctgtgcaaaaaaagtttgaccatattaattttggctgggtggctttggtggtctttgagtttttgggacaccctttaacccatgattgatttttgttcctggttttatttctctaggatcaggtttattcgtgtctttgttcaacgtcaacacccctttcaatttcaatttctatctttgagttaacatcaaagttaaaataaataaaattttgttgatagagctcctttagctctccggaaccttcgtccttgtaaacttttacctgagataatacaagctctcttttgtcgtccttttgtgagtaagcagaaatggcgccttgataaacgatattggtttcacggtcgcgaagaataacccattctgatctttcatcgctaaatatataatcccaaacatcatcttctccatgtttattggagattcccagaaggtttgcaactttgaaaatatactttttatttatgattaccactaagataattgccaaaattgcaccgattaaagttgcgaggaaaacctcggacaccttgatttgctctttgctgtttaacagtgaacttaaaaatgtaactttccaataaagtttatcatttaactggttgcagatataaacgataaacataagaatcccatatgcaaacacaccaattagatatgaatgtaaaatgaaatggaacatttgtcgttttctatgagttgttaatagatcaaggagtgttgcaccaattattccagggagaaacaagaacaaaagccttactgctaaatctgatatatctatatcatcacctcccgcttattgaactcctcctgataaactctttcctttcaatccgacaagaaaattatagcagttcggtgaaaaaattctagtttttttacaacacctgtttacaacggtaaatagatgttgtataattgaagtatgaaaggaggtgctgaggtggacgagatcagaaacatcgttcttatcatcgctggtatcgtgaccattatcaaaaacatctatgatatatggcagaaagaaagcgaaaagcgaaaagcgagaaaagaacatgaaaaagcgctcccgccgggtaagcaagaagcgctaacaacatagtgagacaaggggataaaatccccttgctcgattattatatcacgtccacgacgatatgaaaaaatattttaagcagtacagctcgtttgatatgactacacttattatcatcattgctggtattgtggctattgattacgaaacagccggtacccttgggaaaatcaccatgtttgttttatacttggctgtaatggttattttgttaaaaggattttttatgatgtggagagaaaaccgacatgaaagaaagtgaaaaaattaggtttatccagaacgaagttttgacggctgcggaagtcgccgagctgcttggtgttactcggcagcgtgtaagccagctcaacagcggcgggagacttaaagcggttaaaaaggtgggaacggtggctttgttcttgctggaacatgtacaagctttaaaaaaagaattagaggcagagcggaagaagtatcggccgtatgatcagtaaaagcccacctgttaaaaaggcgggcttttttgtttattatgcttcaagtaaaagagtgttctttttatcaatctgtactgcatataaaggccctttagttatttatgtttccatctttcatttttatatttaaagcatcataatcctcttttttaaaagagacagttactctatccactctatctgaatttggatagaggaataattgttggttaaattttatccctgatggaccaattattcgataaatcaggtttaaaattttaaaacaatctaaatctaccccatcttttaaatggttcttcatactaataattacatagttgttgacggtttcaaatctaggtttttggggagatatattattgattttacaaagcccttttacagattgtttaaaaatatctaaaacctcattattttttgacaaaaagctcacccttttttttgtttatatggtaccattatccatagaaaaataaaataggagttgaattgaatattatgaaaaagttgtttgttttgtcatttcttgtgttttcgtcattcttattagcaattccttctttagcaagtgaaaaacctagtcaattggaagatttatctcagcttggcgacattgtttatcaagatgatgagattacagtaagagattttggcaatgatcctttagtttccaatatcattgctgaagacccaaatagtgttatagctgatgaagatgatggaattaaaccaacagctgtgggtcctggaggaaaggcagttattaacgcagcgactaatggaagaactatttactggactgttagaccagcaacattatggcctttccattttgaaggttttataaaattacgttattattctggttttaaaagagatgcgccaataggtggtatgggggctttaggaagcagtttaagtggagctgtgcacatgaataagaataacggagggtatgcatctttgaagggtactgcgtactcattggatctgagtaaatactcagtattacctggagttggaacttcattctaagaagataattatatatttgttataagtgagtagaccgcaaacaaattgcggttttttttcgttcaaacataatttggaaatgttagaatattatataaaaggaggagtggccttgtgagttctgttttaccatcatcagaggttggcgttaagattaatgaatggtacaaaatgatacgtcagttcagtgttccggatgcggagattttgaaagcggaagtggaacaagaaataaatgagatggaagaagacgagtatctactgatttactacaccctcatgaaattccgccatcagctcatgctggattatttagaaccggttaccacacgtgtgagaccgacaattgatgagttgttggaaaaaatcgaagcgtcaaataaaggaatttccggccttctgtgctattattctttatttttccgcggcatgtatgaatttgaccaaaagcagtatgtaaaggcgatcggcttttatagagaggctgaaaaacaactcgttcatgtgtatgatgatattgagagagcggagtttcattttaaactagctgaagcatattacggtatgaaacaaagccacgtctctatgcatcacgtaaagcaagcgctcgatatttacgatcagtatgagttgtataaggtccggaaaattcaatgtctatttgtcatatcagggaattatattgattttaagcgttatgagaagagtcagccgcatcttgaaaaggctcttgaattatcgaaagagttagataataagagattgattagttctgctctttataatttgggtacaaatttcggagataggggcgactatgaaaaggctgagatatttttaaggcaagcagttgagataaccgaaaaagcaaaattgagcaacttgccgcactctttattttcttatgcaaaattcctttttaaacaggggaaaatggctgagggtatccaagcaagcaaaaaaggtttgtcggccgcggtatatcaaggcgataagctttttgaaaatcttcaggggtatctgaaggcactttatgtggatgcagtggatcaacagggagttaatgaaacaattgagtatctggagaagaataagaattactcatatgttgaagatattgcttgcgaaactgcatctgtttacgcagattcaagggagtttgagaattcttatttttatcataaaaaaatggttgatacgcaaacacaaattcaaaggggagagtgcctgtatgaattttaaaaagagtatcttcatcgtcctgggtctgtcattgactttagtatgtgggttgggtatgaactcactagaaaaacaagcacaagatacaatcaaagtagcttctgatcgccttcaaacttgaacagattacgccttttcttcggaaaaggcttttttgtttcttcattatattgtttcaaaacatccacttgtttttatgcttatcccatttcagcatacgctgccttatgaggttcttcactgcttcccggatagcgcgttcatccttgccggtttttctcttcaattcatccaaggaaggatttttcccaaagcgggtcatgtttaagatgatcctatatactttcctctcaaagtcattcatttgaattacctcctgaagagaataataccagaacaaacattcccttttcaacttgaaatagaacaaaagttcgtatatgatgatagtaaataaggaggggcagcagcatgaaagcattgttaaatcgttcgttaaatgaaaagtcagcactggacatgatctatataaaagctgatgggacagtctcgaaaagaaccatcatagtgcatcaggtaaaacagaattttatccgggcattttgttttaagagtaggcagacaaaaacatttaggatagacaatattcttgccgttgccccggtcaactataaaaaaggggtaaggaatcatgcgtaatcttacaaaaaggcaagaagatgctttaaacgcgatatcgaatttcttaaatcagtatggagtggccccgacacatcgggagttaatggaggaacttggtttgcggtccaccagttcagtgaaggggctgctagataggttaagagaaaagaattacgtaacatggcaagaaggattaccgcggacaattaaattattataaggaagagccctggataagtaagggctcttttttttgaccgactccaaacgtcttatcttgagtgggggacgaattggggacgaactgaattgtacgagatcattttaaaactgtctaaaacattaacacttataacgaaacccttttataacagggaatatcccattaaataattctaagactttaattgacctcttccatggtaaggaagaggtcagcggttcgagcccgcttggaagcttatctaaatacgttgatctgaagcagtttccgcgcgttatggaactgttatttttt

SEQ ID NO: 159 - DNA, 4084 bp, Bacillus velezensis FL50S
aggcctgcttaacggctttctctcacatcattcgattctgtgcgcttatttatgggagttagaattgaaatgcttcgccggcctcgcggctgtcttcaagaacaagaatccctttttccgccggtgcatccggcaaagcgagttcttttgcggagcagatcatgccgcttgacggaacgcctcttaattcagcgtctttaatcacaagtccgctcggcattaccgcgccgactttagcgacgacgactttttgccctttgtccacgttcggcgcgccgcaaacgatttgaagggtttcctctcccacattcacttggcagatattcagtttatccgcattcggatgtttttctttcgattcaacgtgaccgacaacaaatttcggagaaaggtcaaccgtcagcgtttctgaaacgccgtttctgttcagtatttcattcacatcctgaacgaatgtctcagacaaagcgacggggccgttgtcttcaatctgtaagtaagaagacacgttaaaaatgttaaagcccgtcgtttcttttgtttctttgttaaagattctgacgacatcgccttctctttcatagccgatttcttcgcgtgctgcatctttaagagagatcagaagcgtatctcccacaccttctttattgtaaaaagcgttcataagaaaaatcctttctaatcctttttcggccggcttttcgccatgataaacacaggttccagtctgccttcattatacagaaatgaaagggccgtaatcggcaccgtgccgcttgcaaagaagctcatggacatttgccctaaaatatcataacccgattcatttcgaatgtcagcaagtattaatacatcctgatgcggaacggaaatcgctaattcgccttcagcggcctgcttgtattcatgaagaatcgaatcattgagaatccggctggcgtcatagccgtcattcgccctgaaaaaataaaaataattgtccgcaaccgtatcctgtttcacgaccgaaggaagagagcggagattgaatgacgccgtctccctgatgcgttcttttgtccagctttctttctcgagcatacggctgtcaattaagcggtacgtcttgccgaggtcaagcgcgtagtagattctcgtttcggccgtatggtcatcatacacgagcggaatgccgtcgctcgtttgatcgggaaatgacgtggagcggatgaccggatagattccggcttcctttccggacatctcctgtccgctgccttccatcgcctccatcgcttctgacacatagtagacgatttcgtcgatcgcttcttcttttttcgtctcccatttcgcaatgatcggcgggagctccaatgtgatgccttttttggtcgtttgatcctcaacacggagggtgtctttttctctgtcaaaaaagaaggatcggttctcgtgctgcaggcgctgttttaataaatccgccagcttccttgacgtcattttcaaagcccgtggcctcctttatgctttagcaagggaatcggttaaaaattgctcaatttcttctttcgttttacggtctttgctgacgaagcggttcacttcttttcctccgttaaacacaacaaagctcggaatgccgtaaatttcccattccgcgcatgtatcaataaattgatcgcggtctacgtagtaataagtgaattcaggaaagtccgcttccagctcagggagaaacggctccacaaagcggcagtccgggcaccaatccgctgaaaacataaataccgcccaatcgtcttgtaccgctttttgcaattcttccgtgctttcaatctttttcattgtcattcctccatctggattatgagttttttatatgctgatgtttgtccaattggatcataccagactgtttacggcaagaccaactatatgcaatatcattatcatatttcatttgcattatcaagcaagtttcgtttaccattttgcttgtagccgtacgaaaatctgaatatgtacataaggaggggcaaaagatgcagtttgtcgtgtatttagcgggtgaaatccacagtgattggcgggatgaaatcaaacaaaaagcaaaagcgctgaacctgccgattacgtttgtcggtccgatggaaaaccatgaacgctcagacaatatcggagaagagattatgggcgtgcagcccgattctgttttaaaagacgccagagcttctgatatcaacaatttccgtacagaggtgctgatggaaaaagccgattttgtgatcgccctgtttggcgagaaatataaacagtggaataccgcgatggatgcttcttatgccatcgcaaaaggaaagccgctcattctcatccgtccgaaagaacttcatcatccgctgaaagagctttccggaaaagcgaatatcacggtcgaaaccgtaaatcaagcgatgaaagcactctcttatttatttgaaacagaataagcaggccgcttttatgcggtcctgcttacctacactcaccacttcagtattaatcagttcaagaggaaagtttatatttgtcttttttgtcataatcataccttcttgcagaacaaataaaaatgcaaatgactcgactttgtgaaatcgctgctcctctcaatgcttgcagcatgtttttgatttaaaaacgtttatcattgcaataaaggttcgaaggttgtttatctggatcggaaccattttgataataatattgaaaaataatatgtgttacctaattctatttacaatacgctttacacttatattcacaacaaagaactgtctcgatcatgcggcttaaaacagaatgtaaaaacagcagtcaataagtattcaaagggacttattgactgcttattttttttacacattttctctgatcgtttcgaccgtctgtttgtcactcgccatgaccagcttaatgagcatttctttcgccgcggcataatcatcgacatggatgatagcggcatttgtatgaatgtatcttgaacaaatgccgatgacggcagacggaaccccgctgtttgatatgtggacgcgtccggcatccgttcctccgcctgaagcgaaatattgataagggatattgtgcgtttccgccatatcaaggacgaactctctcatcccgcggtgcatgaccgtcgttctgtcgagaatgcggagcagcaccccctcgccgagacggccgaacagctccttatcgccgctcatatcatttgccgggctggcatcaagcgcgaagaagagatcaggctgaatcatgttggccgctgtctgcgcccctctcaagccgacttcctcctgaacggtggccccggcgtacagattgttcggcaggtcttttccgtgcagctcttttaatagttcaatgcttaacccgcagccgtagcggttatcccacgctttggacaatattttcttctcgttggccatcggggtgaacgggcagaccggcacgacctgctgtcccggtctgatccccattttgaccgcgtcctctctgtcatcggcaccgatatcaatcatcatatttttgatctccatcggctttgcgcgctgggcatccgttaaaatgtggggcgggatgcttgagatgacgccgataatcggtccgttatccgtctgcacctcgacacgctgggcaagcagcacctggctccaccagccgccgagcgtctgaaatctcagcatgccgttatccgtaatctgtgtcaccataaacccgacttcatccatatgcccggctaccataacggtcggcgcatcttcagcgccgcgccttactccgaaaacacttccgagtctgtcctgcacgatgtcatccgcatatttcgcaagctcccgtttcataaaagagcggacctgatgttcatttcccggtgcgccgggaagctgcgtcagcgtccggaaaagcgttttcgtttcctcattcatattttcccctcatttctatgtaatgcttttattttattagaaaaacaaccgttttccaagcgctcagattgaatgggctgtaaaaccgccgctttacttaacaccgtctggcatcttctgtataataaaaa

SEQ ID NO: 160 - DNA, 3911 bp, Bacillus velezensis FL50S
taaaaaaacaagcctctttaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcttccagcatttcggtatagcttttcaattcgccgccgacgacagattttaagcctgcaagcaaatcttttccgatgtgacgggactggacgatactgcttgtcaccaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgacggcaaacatgacggcaatgttcagaaccagcgcgatgatgcctgtattcatatccttaatgatctgcggaagaaacggaaagagggttccgacggttgattcggtcagcgtaatgaaggccactgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggaaatcagcgcgataacgggtacggcgtattttgcgagccgtgagactttttcgtcagtcgtgccgggcagaatggctttgtacacatttttggcgaacagcgtgcttgatgccattaatatcattgaaccgggtacaagcgccgtcaggatgcccgccgatccgatcagcccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccaggttttgcggcgtcaatttgtttgaacatctccgtaaacccgccgtaataatgaatgggcagataaatacctaaatacaggacgatgcctaaaatcatgatatctttgacgacggatatccacgctgaaccgtggattcctgaaatcatcacataaatcgtgatggagacagcgccgatccagacagcggcggagggcggaatctgtccgtatgacgttgctgaaacaattaatccgagccctttcagctgcaggacgagataggggatgagggatgcgatgccgacgagcgatacgagaatgccgaggagcgggctgttgtattttgaaatgaaaaaatctgattgcgacatcagtttgtgttgtttggcgtaagtccacacggctggcagaagccaatatgacaaaatgtaggcaaggcagccgtacgcgataatataaaaggccgggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcattcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaattttattatctgaaaaggaaaagcaggcccggctgctttttaaatggtcgcaagagacaggtaatattccaataaggcggtgacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcggccgccatgggcagaaacagccctttttcgatgagatcgcgggtgccgctccgaatgtcaggcataaatactccttctttcttaaaaaaagagaacgtttgttcttattttatactcgcttacacgatatttcaagacggaaaatctcgtaaacattttcgttttttggagataatgtgtagaataaggatagacaaactcgttaaggagtataaacgttggagcaatttttatcatatttgactgaggaacagctgacggaatggttccaaagctatagagctttcggcccggcggctgcggctgtattgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgcgatggggaaaatggttatgatctttatgatcagttttatcgggtatgatcttcacgcactcattacacagcctttcaggatggcgggcgccataatggggatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagcatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgaccggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtaaaaaagcggaggaaagactataatgaaaattgttacgcgcgaaacaaaaa

SEQ ID NO: 161 - DNA, 3085 bp, Bacillus velezensis FL50S
atcgtcggcatgccgacgatggggcgctctgaggctcaatttgagtctgtcatcggatactttattaatatgatcgcggtcagaagcagggcgacgggcgccaaatcctttacggcgtttttgaaggagctgcagctgacactggcagaagggctggaccatgccgcgtatccgtttcccgcgcttgtcaaagaattgaagacggaacgctcgcctgcggtttcgcctgtttttcaaaccgcgtttttctatcaaaacttcttccggacagaaggagcggaaaagctggcggaactatatcaatcactcggcattgaaatgatagaagacattcatcaggaaggcgaatttgagcttgcgcttgaagtctataaaaaagaaacggaaaccgtcctgcaatttctgtacaacccggatgtctacagcccttctttcatcgaacggatggcggagcattatatgaaactggcagaaaaggtgctttctgatccggagatcacttttgaagcctgttccggcctgctcaatcaaaaacgtgaagcaagccgttcatctcatcagccgaatgagcgctgcattcatgaagtgtttgcggaaaaagccggacgccaccctgacagagaagccgtcacattcggtgaaaacagtcttacatatcgcgaattagatgaacgaagcacggcgctcgccgtgtacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaatgaacggatggtccacgtgttgactgacagcggcgtttcaatcgtattaacgcaagcaaatacgcgcggcatgattgaacagttggccgtcggcggtgtgagcacggtggaaattgaaaagagcggacgttctgtcagcggggcaaaactgacgccgcgttcaaaaccgcatcatctcgcttatattctatatacgtccggaagcacgggaaaaccgaaaggcgtcatggttgagcacagggccatcatgaatacgctgcagtttttggaagctgagtatccggtcgcacaagaggatgcctatttgttaaaaacgaattacgtatttgacgtttcgatttctgaattattcggctggtttatcggaaacggacggcttgtcattttgccgcctggtgcagaaaaaaacccgcagctttgcatggaatacatccaaacccaccaggtcacgcatctgaattttgctcccgccgtgtttaatgtatttctggaaacggtaaagcggcatacggcatttacagaagacggccctgtgaaatatgtgatggtggccggtgaggcatttccgaaagatttagtcaaaaaggccgtttccatcttcaaacatgccagaattgaaaacatatacggcccgacggaaacatctatttatgccgcttactacagctgcggccaaaaggaaatcacaagcaggaatacgccgatcgggaaaccgattcacaatacgcggctttatatcgtcgatgaaaagctcagccccgtccctgacggtgtggccggcgagctttgcgtggccggcgccggtctggccagaggctattacaatcagcctgagctgacggcggcatcatttattgataatccgtttagtgaaggagaaaagctttacaagacaggtgatttggccagatggctgcctgacggaaatatagaatatgccggccggattgacagtcaggtgaaaattcgcggcttccgcatcgaattgggagcgattgaaacgaaattgaacgaacatccggacattcttgatcaggcggttgttgttcaggaaaagaacggacataaaaagctgattgcttattatacggcccgctccggtcatacggcagatgaaaaagcgctccgcaaccatcttttatcgagtctgccggattatatggcgcctgcccattttatccgtctggatgcgctgccgttaacaccgagcggaaaagtgaaccgcaaagacctaaaacagcgcaaggtaattgttcaccggtctgaaaagacgggcagactgccgttatcagaagcggaagcgaaagtgaccgcaatatgggaagacctgctgaatacggcgggcatcaaaacagaagacggctttttcgatgtgggaggcgactcgcttttggcagttgcggcggcagaacgcattaaacaggagctggaatgcgattttaccgtcacggatttattcgaacactctaccattcaggcgatcagccgatttattgttgaaactaaacagacggctgaatcagaggcatcaggccaagatgaaagagaaagagaacaaacaccgcaaaacggggtgccgtcttactttgacgacagtgtggcgattgtgggaatttcctgccagttccccggcgcgaaaaatcatcatgagttttggaagcagttaagagaaggaaaggaaagcgtccggttctactcggaagaagaacttcgggaagccggcgtgcctgaagatttgatcgaaaatcccgactatgtgccggcattatcgacgatagaaggaaaagatctctttgaccctgagttctttcacatttctccgaaagacgcagaatttatggatcctcagcttcggcttctgctgctacattcttggaaagccgtcgaggacgcgggatatgtatccaaagagattccgaagacaagcgtatatatgtcggcaagcaataattcgtatcggtcgcttttaccggaaaaaacgacagacggccatgaatctcctgacggctatgtctcatgggtgttagcgcagagcggcacgattccgacgatggtttcccataagctcggattaaaagggccaagctatttcgttcattccaattgctcatcatcattagtcggtctttattcagcctataaaagcatcacgagcggagaatcggaatacgcgctcgtcggcggagcaacgctgcatgcagcgacaagcatcggctatgtgcaccaaaacggattgaatttttcaagcgacgggc

SEQ ID NO: 162 - DNA, 2047 bp, Bacillus velezensis FL50S
caagcagaagacggcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagtgttttacgtcatgaagcagactcatttttccatgaatcacgggattcaggcgctggatacgtatatgaaacacgatttttacagagtgcggagaattcaatgccatttcgtcatttcaggaaactacatcgactgcaaaaactacgacaaagcgcttgagcatttagacgaagccctccgcctttctttgcttgaaggacagccccgcctgatcgggtcttcgctttacaatctggggaattgttatgctgaaaagcgggatctggatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagagggatcatgatcgcgaaagaacgcggcgaccgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaacattcaaaaagaacagtgtttatacgatatataatttttcttaaccatctgatcagcagatggttatttttttatgcacatcaggacgtttgatcatagaaaaaatcggaaaaatcgcaaaagagggaaaaaagtacgatgggaaggagggatttgttgttcggatttaatgatatgataaagtttttcgtttcatttctcatcattctcccgatggtgtctgtcatccatgtgtcgggacacagctttatggccatgctgttcggaggcaaggcgtcgttggatatcggaatggggaaacgtcttttaaaagtagggccgattcaggttcggcgtatctacttcatagattctttctgcaagttcggcgaattgcggatagataaccgtctgacgagcgcgctcgtctattccggaggctgtctgtttaatctcgcttctatctttttaataaatctgctgatcataaaagatttcctagagccaaacttatttttttaccaatttgtctatttttcaacttattatgttttctttgctcttctgcccgtgcaatacggggataataagctgtcagacggattggccgtttacaaagtgatccgctacggggaacgctgtgaaatcaataattgagagttgaaatgtttgctatcaggctgaaagggaagaaaacaagtacacaaaaacaaaaggagctgaagagatcatgagtgaagataacggtttaaaagacaaagtaaaaggcggcatgaacaaaatgaaaggggaagcaaaggacaaagcaggcgacatggcaaacaagtccgacttaaaagcggaagggaaaaaagacaaagcgaaaggcagcctgcaaaagggtgtcggtaaaacgaaagataaactcagtgatgattaatttgatcgtgaaacacagcaaaagcccaaaatattttgggctttt

SEQ ID NO: 163 - DNA, 2023 bp, Bacillus velezensis FL50S
ctccggaggcaaaagcggcgtaaagcgcctggatgcctgaagccgatcgcatggctttcattccggtctgttcatacatcagccgttcggtctctttgtccacgcgcataccgccttcttcccaaagcggccagttgacggacagggtctgcccgctccgcttgttgtcccgcacgagacgatttcggcgggctgcataaacatccataaatgcgttggctgccgcataaccggcctgccccggatttcccatgcctcccgccaaggaagaaaacagaatgaaaaagtccagccgtacatctttcgctgcttcatcaagattgataagccctttcaccttcggcgccatgacggtcttccgttcgttttctgtctggttcagaatgtaattgtcggcgatcacgccggcgccgtgaatgatcccgtcgagtgttccgtgctcctcctgtatgccgcggacgagggcgatgaccgccgtcctgtctgtcacgtcaaccggttgatacaatacgcgggcacccgtcgcttccaagcgccgtaagcgggcggagcgctcttcatcaagcgcttccgccctccccgttaatatgaggacggcgtttttgacgcgggaagctatttcttcagcgaaaatcagtccgatgccgcccgctcccccggtgaggaggtagaccccttcgtctttccacggaatggtgccgctttgaggcgcaggcaggtgacgccagtttctgacgagacgtttgccggcttcataacggatttccgcttgttcagggtgcgcccggttttctttcagcttggccagaagcgctgatgctgactcgtccggatcagcttggatgacttggccgtacagcttcggatgttcaaggtgagccgttttcagaaaagcggccagccccgccaatacattgtcttcccccctgtcggggacaagaagctggatcagcgtttttcccttctgtttttctttgataagacgcttgacgatcgctgacagctccgccgcacaggcgtcataacggtcttcaatgggaccttcgccgtcagccgcacatacggcgccgtttatgtcctcagcgttcattccgccatacagcgtcacgtatctgaaagactctgcttgtccgccgccttcacccggcggtgattcctgccactttggctgaagcaagagcggttttccctccgtttcctcttccagaaaacgggcggtgagccccgtcaatcggacacatacctcgccgttttcatcacacagctcaatatgataggcgccgtccgctgaggaaagcaccgcccacatcgtctcacggcatgcagaaaacacctgcatatcttggagggcaaacggcagaaacggccgtccggacgcggaaccgtctgagtgcacgagaccgatagaagcctggagggcggcgtccagcatgctcggatgcaggatgaacggctccttttcttcgcgggcggacggcggaagagtgagcttcgcgagcacttctccgcttccggcatagacggcgtcaagcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttctccttcggcatacgcttcaaaagcgatgtctccgtttttttccggctgaagttttacatgaagcgtcacgccttcagaaagcgccgtcaccggacggagccaaacgatctgtttgagccggacacccgctttcccgcccggcaagtcctcagcggcaagcgtaacggcggcccgggccatttctaaagcagccgcgcccggaagcaccggttttccattgacgatgtgatcggcaaaaaacggttcacgccctgaaaaaacagaagtaaagcgctgggcggtaaaggtcgatgtattcgcatggagcagcgggtgaag

SEQ ID NO: 164 - DNA, 1941 bp, Bacillus velezensis FL50S
tgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacg

SEQ ID NO: 165 - DNA, 1897 bp, Bacillus velezensis FL50S
ccgccatatggctgaacccgccgagatccaaatacttccggtcttcctcccccgccggctccacgacaatttccttttgcgcgtagctgatggacaggctgagctctccttcgagatactcatagatcgaatcttcacaaatcgccttcgttaatagaggcacatgttttttcacaaagtaatccttgtccaaaataatatgttctccgtcaatccgtcttgatctgacgacttcccacaccttttcatccgcttctgtaccaagctcttttgcggcttccgagggaggcaggatcagcccgagacggtgaacctccgttctcgtctcttttccgagcgtttccgaaagctctttgaagctgatcaggcctgagacgggaaagcgcattttttctctgtctaatatgacggagcctttgcctttgattttctggatgtagccgttttgcgccagcatattgagcgctttacggacggtttctcgtgatgtgccgtattgatcgcataaatcattttcagacggaagaacgtcttcagccttccgctggccgctttcaatctgccgcaccatatctttatagattgtgatatatttattcactttcattcatgaccacccagattagtgtatcacgcttttgtcagatgataaacgatcgattcatacggacggagcgtcaatcgttccggccgcccttccctcggttcatcattcgtcagcagcaccgtaaaccgccagccgtccgtgtctttaagcggaaccgtaaagtccgcttctttcccgtagaagttgttgatgcacagaagtttttcatccttgccgtgtctgacgtacgccagaaccgccggatcatcttcagcaagcagctcaaacgttccttcagtcacgatgtcatattcctttctgagcttgatgagcttctgataatggtagaaaattgaatccgggtcccgcaaagccgcttccgcgttaatgtcccgataatcatccgccgccggaatccaaggcgttcccgtcgtgaagccgccgttcggcccgctgttccattgaacgggggttcttgcattgtctcttgatttctcttttaaaatggcgataatgtctttttctgacacgccttcttccttcatctttttgtaaatgttcagtgattcgacatcgcggtatgagccgatgtcatcgaacttcggattgcccatgccgatctcctcaccttgataaatgtaaggcgtgccctgcatcatatgaatggccgccgccagcattttggctgatttcgtccggtatacgccatcgtctccgtatctggatacggcccgcggctggtcatggttgcaccagaataatgcgttccagcctccgccgttttgcatctccgtctgccaaaacgctaaaatccgtttcagcttcagaaaatcaaacggagcgagcgcccatttttcaccatttggataatccacttttaaatgatgaaagttaaaggtcatatcgagttctttattttcagggtttgtgtaccggatgcagtggtcagccgttgtcgaggacatttcaccgaccgtcatgctgtcatatttcgaaaacacttcccggttcatctcatgaagaaattcgtgcacgcgcggcccgtccgtataataagggcgcccgtcacgaccatcctcggcatcaggaaacgattggtctttagaaatgaggttgatcacatccagccggaagccgtcgatcccttttcggaaccaaaaatgcatcatgtcgtaaacctgttttctcatctcttcattttcccagttcaaatcggcctgcgacacatcgaataaatgcagatagtgctggcctgaggccgggtcgagctcccaagcggaaccgccgaattttgattcccagttgttcggc

SEQ ID NO: 166 - DNA, 1890 bp, Bacillus velezensis FL50S
gaaagaatacgcagaaaccgaagcgaacgaacagttcatccaagccgactttgagcagctccaaaacgccacaggcaaaggaaaaagcgccacgccgcttcactacaacgccaaagcgtaccgagaaagcgacatccataagaagaaaggcgatatcgcaagacattcggatgcttatttgacgattaaaaaggaagaagcgaaagagcgtgaaatcaaggatctgaagaaaaagctggctgatggtgtcaccgatccgaatgaatacttagagatcgccaagaaggttggctacgagaatctcacccctgaacagcttgaatttgtttcatttctggaacagcgtaaagctttcatggataacggaaaagaagcattgcaaatcataggtgatggcgccaaaggtctgcttgttggtgtatacgatcttgccaaggataccggtgaaggagcacttcaactcggacggaatatcggttggacaattgacaacttaaacaaagatcctcaaaaagttctggatactgttctggaatatgactatctaggtgtctttcaaagtatggttgacacattgaaggatgattgggataaaaagatgattcacggggatgcatatacacggatgcactatgttacttacttgggcggaagtcttctgttattgaaaggaggaaagtcctctgtctcaacaggctcaaaagatcttgctaaagttgggaaggcggctagcgaaaagattaaaaatggcaatccatctgtcaagccttatgccaatagatataccccggcattagaagggattttacaagacgccgggaatactattaatgttaaaaatacgccgcttttaaagagattagttcaatcaaaggatgatttgtttactaaagccgcaccttatacttacagagatgaatacggaaacctcaaaacagttaacttaaaaatgggccatcttaaaaaccaaaaacatcctaaaactggagttccatataataaagacggtttcccaattttcaaagcaaaatttgatacgaagattgattctaaactctataaggaaagcgattatttacaatttaaagatgcaaccttaaaattaaaagaagaaattgaaaaagatcctttacttagaaatcaattcaatgaccttcaaatcgaaatgataaaagctggtgaaacaccagacggatatacttggcatcatcaccaagattcagggagaatgcaattagttgaccaaaaggtgcatcggcaaacaggccatacaggaggtcggcacctttggggtggtggaagtaagaacagataggagttggtcaatatgacagagtggagatttgccgaagaacccatcggggaaacaactgttaaaaaaatcgaaaaggctttagatattaagtttccaaacgactacatttcaactattttaaacaacaatggagcacgcccaagtaaaaagatttttgactatgaaaatacaaaaggcgcggtttttaatcgattacatggtctaactgaggatagttcaagttttattttagaggttttagaagattatcaggatggaagaatgctttcagggatagtccctttcgcctgtgatcctttcggtaatgaaatctgtttcgattatcgtcagaataaagaaaatccctccgtggttttctgggatcatgaaattgcttatgaagaccctgatggagctttgagtcatatatctgattcattttccgatttggttaataaactatacgatgaataaaaagataagtcccttctcataacgagaagggattctcttattttagtagagcttcaagcttcgcttttgttttcggcccgtaaatgccgtcagcagccagaccatacatggactggaaccgt

SEQ ID NO: 167 - DNA, 1864 bp, Bacillus velezensis FL50S
ctgtgccgcgggacaaaacggttcatcgtctctttgaagaaacggccgcccgctacgcgaaccggccggccgcggcatacaacggcgcgaaatggacgtacggcgagctgaacgcaagggcgaaccggatcgcgcgcattctcatggactgcggcgtcacggctgatgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagctgcttctcacacaggaagcgctcgacgtgccggatggctacaaaggtgaaacgattctgcttgacggcggacgctccattctgagcctgccgcttgatgaaaacgatgaagcgaacccgcagacggaaacaacggcggatcatctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggcttcggttttgacgcctccatctgggagatgttcccgacatggaccatcggcgcggagcttcacgtcattgacgaagcgatccggctggatatcacccgcttaaatcactatttcgaggagcacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggcgaattgtgcgtggccggccgcggtctggcacgcggatacctgaaccgtgaagaagaaacggcgaagcggtttaccgcagatccgttcgtgcccggcgagcgcatgtaccggaccggcgacctcgtcaaatggaacgcgcagagcggcatcgaatacatcgggcgtattgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcagcagaatgatattgaagcgctcaaagccgcgctgaaagacacgctgcctgactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttccgacatttgggaggaagtgctcggtcttgatcagatcggcgtaagcgataatttcttcaccctcggcggcgactcgatcaaaggcatccaaatggcgagccgcctgaaccagcacggctacaagctggaaatgaaagatctcttccagcacccgaccatcgaagagctcgtctcttatgtggagcggacggaaggcaagcaggccgatcagggacctgtcgaaggcgaagcggagttaacgccgatccagcgctggttctttgagaaaaacttcacggacaaacaccactggaatcaatccgtcatgcttcatgcgaaagacggctttgatccgga

SEQ ID NO: 168 - DNA, 1837 bp, Bacillus velezensis FL50S
ccgcctaattcaaaaaagttgtcatctatgctgatttcatctgttttcagaacgcttttccagatatcaactaaatctctctcaatttctgttcgaggttctttgattttccttccaatcgatgcttgatctgtaacgtctaaagccagcagttttttacgatcaacttttccgttacttgttaaaggaacttcttcaatctgtacgatatagctaggtatcatatattccggcactttcaggcttaaaaactctttcagatcagttggcggtaaggattggtgccccgctacgtacgcatataacacatcttgatttctggcatccttttgattaatgactaccgcgtttctcacctgtcggtgctctaatattacactttctatttcacctaactccacgcgatatccacgaactttaatctgatgatctttccgtcccaaaaactcaatataaccctcttgcgtcaagacccccatatcccccgtacggtaaattcttccgaaatctgggtgatcaataaatgaagcttcagttttttctttatcatttaaatagccttctgctacgccttttcctcctatgtaaagttcacctttaactccgattggacaaggatcattttcatagtttaaaacatagtaagtttgatttgataatggataaccgtaaggaatgctggtccattcagccttgactgttttaattggataataaatcgaccaaattgacgcttcagtagccccgcctaagcttatgacttcactttcaacgaagtgatccttaatcctctcaggaagatgaacaggtatccaatccccgcttaataataccagtcttaattcaggaagctcgtcatagttaataactccagcgttagatttgttttctgtttcatccatgtagtttactaacatttccatgatcatgggaacggagttccagactgtaattttttcctcttttacgatgtcatgaatctttttaatatctctctgatcttcgatcattactaatgttgctcctgcagaaaaagcaccaaaaatatcatatattgataaatcaaaggacatagatgataatccgataaaccggtctgtttcattcacactgtatttttcattgatgtctaatattgtattagttactgcctcattctttatgattacacctttaggttttcccgtacttcctgaagtgtatatcgcataagctatttgttccggcactgccacactttctcttttagactctttatagcttgccacaatagtttttgccagttcagctgttaatacaactttacaatttccatctttcgcaatatatgtttgtctttcttttgggaattccggattaattgggatataggcagctccaatttttaacactgcgaggatactggcgattgtctcgatctcacgatcaacaataaccccaacatactcatttggctgaattcccttctcttccaaaaaactagatatgcggttggacatgccctgtaactcttgataggtaactgctcttccttgacactcaatcgcaacattctcaggtgtttttactgtttgtctggcaaacaagtgatataaagtatccggcttgatggccttctcagtttgattataatcagtaattgcttgttccagtgctgtgtctccagaagacatcttctcaccggacgttaattggtcaataatgtgggtatattcctcaaacattgactcaattacgtcattttcaaaagcctctgaaacatagtcccagctaagcatgactccatcattgagctctatcacttgatgatccagataaacttgtgatgtctgactga

SEQ ID NO: 169 - DNA, 1707 bp, Bacillus velezensis FL50S
gggtagcctccgtagccgccatagcctccgccgtaaatcggtcttctttcattcatgatttatcgctccttcacataggttacagtccagtttatgacatgcggaaggaaacgtatgggcatccgcccagttttggcgaaataatcaataattgcttacggagaaatacaatacaggccggccgcataagcaaaataaaaaggccggaacttatgccgccccggcctttttgtctttattcgcctaaatctacattgtgataaacctgctgtacgtcttcgaggtcttccagcacatcgatcagcttttcaaattgagctttcgcatcttccggaagctcgacttcattttgcgcaagcatcgtcagctccgcaaccgtgaactcttcaacgccggcatttttgaatgcctcctgtacggcatggaattgatcaggctcagcatacacgataacactgtcatcctcttctaaaatatcgcgcacgtccacatcagcttccatcagcaattccagcgcttcatccgccgtcttgccttcaacgccgataacggcggtcgcatcaaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtcctttgatgctttcttttctttaatattgttccacttacggcccattttgttccactctctttcacgaattgaatctgtatgataaatactctgcttctattatacctcagcggttgggttgtttcgagtgtaagacattagaaaaaacaggcacgcttaaaatcaccggagcgcagtaagccgaatttgaggattattgtacaaaacataaaaagcctcccttcatacaggaaggaagtcgcaagccaaaagattcattttattcttattacctatttcctacactgtatatcctgactcccgtggtaatattttgatatcgaacaaaagaaaggattatagtcatgaaagttttcgaagcaaacagcctacccaagaggtgagaacaatgatcgaaacaaatatttctgaacctgtatttcaatttttaggagggactttccatcaagatatagacactcctgagacagcacttgaagaatacttagtagagatacctaaaaaagaacaagaaaacgatgtagtagcactcaaaacgtttataaatagcaattactcagatgaagaaaaaaatgattttatagaagagtctgcagatggtgtagatatcaatagttacggactatccccaatactatggctcggacaagtcattcaaaaaatcgaaaagaatattgaggctttatagattcagggaaaccctattcctatgtttgcacagtctctgataagtttcttaatctttccctctataaactgaaaaaataaccccgaatgaaaggatatggtcatgaaag

SEQ ID NO: 170 - DNA, 1620 bp, Bacillus velezensis FL50S
ggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaagga

SEQ ID NO: 171 - DNA, 1520 bp, Bacillus velezensis FL50S
ccgcggctaccggattgaaccgggagaaatcgaagcggcgatccggcacatcgacggcattcgtgaggcggcggtcaccgcccggaccgaacacggcgaaaccgcgctttacgcctatattgaaggacgaaaaagcgatgacgtgcgggcggagcttgcgacacgccttccggcctacatgatgccggctcagtttatagagatgagcgaatggccggtcacgccaagcggaaagcttgaccgccgcgcgctgccggctcccggcggatcggcagacagacaggcgtacaccgccccgcggaacgtcacggaaatgaagctttgcgccctttgggaagaggtgctgaaaaacggccccgtcggcatccgggatcacttttttgagcggggcggccattcgttaaaagcgacggctctcgtctcccgcatcgccaaagagttcggtgttcaggtgccgttacaggacatcttcgcccggccgacggtggaagagctcgcttcggttattcaggacttggaagaaagcccgtatgaagcgattcagcctgcgaaaaaacaggacacctacccggtgtcttcagcgcagaaacggatgtatgtgctccaacagcttgaagacggcggtgtcggctacaatatgccggctgtgctggaactgacgggcccgcttgaccgtgtccggctggaggagacgttccgggagcttgtggagcggcacgagtcgctcagaacgtcctttgaaacggggcctgacggcgaaccggtgcagcgcatccatgacagcgtaccgtttcagctcgatgaggccgagtcagctgacgcattcgtccggccgttttgtctggaagaagcgccgctcttccgtgcggctctcgtgaaagaatcagacgaacgtcaccttttattaacggatatgcatcatattatttctgacggtgtgtccgtcaacaccttgataaaagaattcggcgagctgtacgcaggccgttcgcttgcgccgatgcgccttcaatataaagactatgccgtctggcagcggtcgtttcaggagaaagaaggataccagaagcaggaagcctattggctgaagcggcttgaaggagagcttccggtgcttgaacttccggctgacaagccccgtccggcggtcagaagctttgcgggcggcagcgtatcgtgcacgcttgacgctgacacggcatccggccttcaccgcatcgcccgggatcacggctccactttgtatatggtgcttctcgccgcgtacaatacgttactcgcgcgattgagcgggcaggaagacatcatcgtcggatcgccgattgccgggcgcccgcacaaagaccttgaaccgattctcggcatgttcgtcaacacgcttgccatcagaacggagccgaagggggacaaacggtttaccgattatttggcggaagtccgccaggcggcgcttgaggcgtatgagcatcaggactacccgtttgaagagcttgtggagcggctcggcgtgcagcgggaca

SEQ ID NO: 172 - DNA, 1349 bp, Bacillus velezensis FL50S
caacttttttgaattaggcggcaattccatattgatcattaatttaattactgctattgaggatcgtttatttattaaattagattttaaaaattttatatccaacagtaccattgagaaactagcaaaagtaatcagtgtttctgaaagaaaaagtaaaacaaatagtaatgtgatggaaatccaagctgatattaagaataaaaatacagaattcgatttaactaacgttcaaatggcttatcttatggggagagataaacaatttgaacttggtggcacttccacgcatgcttatttagaaattgagactgagctgaacattgaaaaactcaacaaaagtttacaaaaagtaatagattatcaagacatgctgcgtgcggtcgttcttccgaatggaaggcaaaagattctccaacaagtccctcagtatgaaatatctgtacaggatattagtcaattaagtgatatagaacaagagaagaaaatagtagaagaaagagacagaacatcacatcgtatctttaatccaaatgagtggcctttatttgaattcaaagccttgaaaattcaaggggataaacatagattatttttcggtatcgatatgttaatagctgatggtgccagtatccagcttttatttaaacagatatctgaattttataatggaaaagatgaaatggtgccattggaaataagctatagagattatatgttagcataccaaaaagtcaagaccactcacaaatatgaaaatgataaagcctattggttaagtcagctcgaagattttccaaaagcacctgcggtgccattaaaagaaagattagatgcaataagcaagccaactttcaatagaaaatctaaaataattgacaagcctctatgggaaacattttgtaaaaaagctgcaagctataatattacacctgcaataatattatttacagcctacgcaaaagtgttgtcgaagtggagtaaccaacaaaacttagcggtaaatacaacagtatttaatagacagcctttccataaacaagttaatgatataataggtgattttacatcgctgattatgttaaaagcgagttttgagaaaaaaatgaacttttgggaggaggcaaaaaaggttcaggttactttcatggaagcacttgaacatagagactatgatggagttgaatttataagagaatatgctaaatataataatctaaatcacaaaagtgcgacaatgccagtagtgttcaccagtatgttatttggaaacatgtttaatcttaataataatgatctattaaatattggtgagttaaaaatggcagtcagtcagacatcacaagttt

SEQ ID NO: 173 - DNA, 1152 bp, Bacillus velezensis FL50S
atttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgatcgaactaaacggaaaattagatgtaaaaaaagccgaatcagttttacaagagattattggcagacacgaagccttacggacaagtttcgatgttgtaagcggcgatgtggttcagattattcacgatacatgggagctcgaatttaattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaagagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatgtcatgctttcaaaatacagcggtcagcaggatgtgatcatcggaacggcagagtccggaaggtcagataccgaactggagaatacggtggggatgttcgtcaatacggtcgccataagaaattttcctgaggaacataaaacattcagagcgtttttagaagaggtcaaacatcatacgttaaaagattttgagaatacagattaccaatttgaaaatattgttcaaaaactcggggtgaaaagagattcgagccggaacccgctgtttgatgtcatgttt

SEQ ID NO: 174 - DNA, 42 bp, Artificial Sequence
  Primer
acactgacgacatggttctacagcggccgcacttgtgtataa

SEQ ID NO: 175 - DNA, 47 bp, Artificial Sequence
  Primer
tacggtagcagagacttggtctctagcatagagtgcgtagctctgct

SEQ ID NO: 176 - DNA, 56 bp, Artificial Sequence
  Primer
agatcggaagagcacacgtctgaactccagtcacacactgacgacatggttctaca
